United States Patent 10,717,768 (PROTEINS FROM ANAEROBIC FUNGI AND USES THEREOF) - sequence listing, part 3

SEQ ID NO: 25085 - DNA, 1074 bp, Neocallimastix californiae
  Glyco_hydro_catalytic_dom
taaggaagctccattccgttttggtgttggtttaaatggtgttgatataaataattacactccaagttcaaagaaaatgatggaacttatcaagtatcaatttaactctatgacttattctaatggtatgaaaagtattaaaattatggatgaagaaggatctcgtaagaatatagccgaaggtagagaagaagttgctgttgacttttctggaattattgatggtcttgaatttgccaagaaaaatggtattcacattagaggtcacgtcttagtttggcacaaacaaactccagactggttcttcagaaaagattttgatactgaaaaggaatatgctgatgttgaaactatctttgttcgtttagaaagctacatgaaagctttctttgacttccttaacttcaattacccaggtgttgttgatgtctttgatgttgttaatgaagccattgaagtcagagaaggaaaattcgataactcaactggttggtacactcgtactgaatctcttgaaggtgatgacaatatttggaatactcttgttggtccaagttacgttgttagagctttccgtattgctcgtaaatacgctcttccaactaccaaattagtttacaatgatgttgataccttcatgactaagccacatgacaagacccaagctgttattgatctcatgaacatattaagagctgaagatttagttgatgcccttggtatggaatcttacattgatcaagacttagttaatgtagatgccccagaagactacgctcgtgccattgaacgtttcaccgaagctggtttagaaattcaaattacagaatttactatctacaatgatgatagagaagattggttagaaactcaaactaagagatacagagacttcttccaagttgttatagatcatgttaagaagggatatgataatatttctagtttcactgttttcggtttacaagatggatacagattctacgataatgatactcaaaaaactcgtctcttcgatcatgatcttcaaaagaagccaaactactatgccatcatggaaattttaaagcaata

SEQ ID NO: 25086 - DNA, 918 bp, Neocallimastix californiae
  Glyco_hydro_catalytic_dom
gattcaatacactggtgtcaatgaatctggtgcagaatttggagaaggaaaataccctggggtatataataccgattatatttatccagatgtcaaagctattcaagcctctattgatcaaggtatgaatattttccgtgttggtttttcatgggaacgtatgcaaagaacattaaattcagcctttgatactacagaatttaagcgtttggatgaagtgattagttacattactaaaaatggagcagtcgctattcttaatccacataacttcgctagatatagaaatagtgttgttggttccagtcaagttccaaattccgcctttgctgatttctggaaaagaatggctgataaatataagagtaataataaagtttggtttggattagtgaatgaaccccatgacatgccaaccgaacaatggttctctgctgcacgtgatgctgtcaatgctattcgtaaagcaggagcgaataataatgtattagttccgggtaattcctacacaggagcatggtgctggacgaaaacacattatggatcaccaaattcaaaagtagcacttgaatattttaatgcttccgataaaaatattatttatgaagttcatcaatattttgatagtgattattctggtacgcatgagcaatgtgtacaacgtccatgtaataaacttttcactgattttgttgattggttaaaagaaaataatttgaaaggtttcgttggtgaacttggagcagctatcaataatgactgtaaagcctgtgtagaagaagccttaaactatttagaaaagaattctgactatgttgttggttggacttggtgggcagctggtccatggtggggtaattatatgtattccattgaaccaaaaggtaatgcattcccagaacaaatgacctggttaaa

SEQ ID NO: 25087 - DNA, 957 bp, Neocallimastix californiae
  Glyco_hydro_catalytic_dom
tcaacaagttcgtccagatttttattttggtgtagcaacatcgattgcttattcctctaatccaaaatataaggatattgtttcttcttttaatttacatgttggaggaaatgaatgtaaattctataccattcaagcttctaaaacccgaaatttctatcaatgtgatcagtcattgtcctacgcaaaaaaatttggagccaagtatcgtggtcataatctcttctggccagcaaattcaccaaattggtttaagacctacagtgatgatattgaagttactaaaagctatattattgactacattaaaagtgttttaaatcattatcgtgatgatgatagtattatctattgggatgttattaatgaatcagttatggatgaatccacctccaatgatattcaattacgtacaggttcaaaaactagtgatgaatttttgggatgggatacgtataccgaggatatctttaaattagcaagagataatatcaatgaaaatgtcaaattgatttacaatgattattattgtgaagccaataatggtaattttgatggaaaaacaggtgcagttttcaattacattaaaaatatgaaggaaaaggaggttcctattgatggtgttggtcttcaaatgcatgtttcttgtaatgacgcaccatcatatgatgatctttacctgttgatttcacgatatgaagaaattggagttgaagttcacgttactgaaattgacgtaaccatggctcgttgtaacagtctcaaagatcaaaaggatgtctatatgaatattttcaaggcttgttttaatcataacaactgtaaagttttcactgtctggggagcctatgatacagaatcatggattggagctgagaatactccattaatatttgattcagatatgtatcccaaagatatctattttgaaatgttagattatgttttaggtaaatt

SEQ ID NO: 25088 - DNA, 151 bp, Neocallimastix californiae
  Glyco_hydro_catalytic_dom
tgaaaatacaacatcatcaccaattcgtgatattccctctaaagaattaattaaagagatgaaatttggttggaacttaggtaatactttagatgctcaatgtattgataacttagattatgaaaaggatcaaactgcttccgaaacttgc

SEQ ID NO: 25089 - DNA, 1035 bp, Neocallimastix californiae
  Glyco_hydro_catalytic_dom
aggtttcttatctactaagggtagaaatattgtagaccagaaaggtcgtaatgttaaattagctggtatttcatggttcggaggagaaactgataatctttctccacatggtttatggtcaaaatcgttagctcacttcattaaggttattaaggataatggctataatcatattcgttacccatggactaatgaaatgcttctctcaggtgccagaactaaatctattaatgctatggaaaatccggatcttgctaatcttacaccattagaagttatggatgccgttattaatgctgctggtaaggcaggtttaaaggtttaccttgatcgtcatagaccaactgcagctggtcaaagtgaactttggtatatttctaaagtggatgaaaagaaatggattgaagattggaaattccttgctaagcgttacaagggtaatccaacagttatcggtgctgatattcataatgaaccccatggtactgcttgttggggttgtggagaaactaagcgtgattggagacttgctgctgaaagatgtggtaatgccattcatgaagtaaatcccgattggcttattattgttgaaggtaatgatcattatggtgaagaaggttggcaaaagggtgaatcctactggtggggaggtatgttaaagggtgttaagcaataccctgttagattaaataagaagaacaagcttgtttattctgcacatgattatgataagaatgttcatttacaagattggtttaaggtatctaacttcccagacaatatgccatctatttgggatgataaatggggttacattgcaaaacaaaatattgcaccagtacttattagtgaatttggttctctcttaaaggataaaactgatgtaaaatggttacaaaaccttatttcttatatgaataagaatggtgttcattggactttctggtgtctaaatccaaattcaggtgataccgaaggtattctcggttatgattgggaaacagtgaataaacaaaaggatggaattcttacacc

SEQ ID NO: 25090 - DNA, 1053 bp, Neocallimastix californiae
  Glyco_hydro_catalytic_dom
ttccctcttaggttgtgctggctcaactttagctttaacttcaaaggaaattactaaagaattaggacttggttggaatttaggtaacaccttagaagcttgtggagattggattaacggaaaaactaccaagcaatatgaaacggcttggggtaatcctgtaaccaccgaagaaatgattaagggtgtaaagagttatggtttcagtacagttcgtattccagttgcatggagtaatcttatgtcttctaattatactattagtcctttgttacttaatagagttgaagaagttgtcaattacgtcgtcaaaaatgatatgtatgctattgtaaacattcattgggataatggctggttcacaaaatttgctactgatgaagaagaagcttttattaaatataaaaggatctggggacaaatatctgaacattttaaggattatgatgaacatttgatttttgaatctttaaatgaagaaggttgctgggaatcaatttggaataattattcaaatgaaggtgataaacctaaagcttttggtcttttaaatactattaatcaaaactttgttgatattttccgtaactctggtggatataatgctgaaagattcttacttttagctggttattgtactggtattgatcacactatcgataaaaattatattcttccaaaagatgataaagttatggtttctgttcattattatggcccttccacttttactattcttgaagaagatgccgattggggaaaagctgcttattattggggtactgaagaagaaatcaataatattactaatgatcttatcaaagtaaaaactcattttgttgataataatattcctgttattattggtgaatacggtactgctactacaaataaggatccagaaagtgttcgtaagtggttaagaactgttgcaggaaaggcaacagaattgggtatatgtccaattgtttgggatgctggccaatattttgatcgtaaagccttaactttcaaagatccacaaattggagaattatacaaggaattatctag

SEQ ID NO: 25091 - DNA, 1047 bp, Neocallimastix californiae; identical to SEQ ID NO: 13730
  Glyco_hydro_catalytic_dom

SEQ ID NO: 25092 - DNA, 1062 bp, Neocallimastix californiae
  Glyco_hydro_catalytic_dom
gaaggaagcgcctttccgttttggtgttggattaactggaaccaatttacaagtttccacaaccgtttcggaaaagatgagagatatcattaagcatcaatttaattcgatgacctacaccaatttaatgaagcctctctacattttagataaggaaggaagtatccaaaatattaagaatggcattcaagatccaaagttaaactttactagtatcgtcgatggattagaatttgcttataaaaatggtatccacattagaggacatgtcttgatttggcacactcaaactccagattggttctttaatgaaggctatactgacgatggaaaaaaagtcagtccagaggttatggaatctcgtttagatagttatataaaacaatatcttagttttgtacaatttaattatccaggagtagtagatgtatgggatgttgtcaatgaagccatagaaattactgatggacaatatgatgccaatacaggatggtatacccgtaccatgttaaacaatacccctaatccatattacgatatgtttggaccagattacgtcattaaagccttccgtatagctcgtaaatatgctcttccaaatgtgaaattagtgtataacgatttcaatacattccaagtatggccccacaataagacacaagccattatggatttagccggaattttacagaaagaagatttaattgatggtattggattacaatcgtatttaggagtcacctggccatcccttgatgaatactttagaggtgtcgaaagattagccaccacaggacttgagcttcaaattaccgaattaactattaccgccccagatggagataattggttagaagcacaagcagaacaatacagagatttctttgaaagattaatgaagcatgttgaagaaggatacaatattggcagtgtcaccgtatttggacttcaagatggctatctcttctacgctagtgattcgacaaaaacaagacttcttgatcatgatcttcaaaagaagccaaactttgaggcgattatgagcattttaaaatcttataa

SEQ ID NO: 25093 - DNA, 852 bp, Neocallimastix californiae
  Glyco_hydro_catalytic_dom
ttcaatgtttatcggtgcttatgtaggtggacctgaagatcatcctaaaccaacccaaaaaaatattgctgctttcgaaagtttacaagatagacacttggatgttgttcatcttttcattcattgggataataaagatgaaccatgggaatgggctcgcaattttgtagatatcgctaaagctaatggttccattatgatgatttcatggatgccacagccatatactgctcaagatattcttgatggaaagggtgatgaatacattgatactttcgttaaaggtgtcaaagattttggtgaggaaatttggcttcgtcctcttcatgaagccaatggtgattggtacacttggggtactggtgctgatagaattaataattcggaagataagcttgcagccgcttatcgtcatattgttgatagattccgtgatgcaaacgttaccaatgttaaatggatatggactactaactgtagtaattctggagtagctactttaactggttcttacccaggtgatgattacattgattacacttctattgatggttacaactggggtaccgctcaaagttggtctcgttggaatactttcgaagaagtttttgataatgcttacaaagctcttattaaaattccaaaacctatcttccttgctgaattttcttcctctcgatttggtggtgataaagctggttggtttaccgatatgttcaatttacttccagaaaaatacccaagaattgttggtcttgttatcttcagtcgtagtaaaaatgaaacagaagctgattgggctcttgattcacaagaagaagcagtagaagcttggagaaaaggtgtcaatgc

SEQ ID NO: 25094 - DNA, 927 bp, Neocallimastix californiae
  Glyco_hydro_catalytic_dom
ttattctaagggtttcagaattggtgctgctactaacactattcactacagtaattctaactataacaatgctatgaaagctttcaattatatggttgctgaaaatgcttgtaaatttgttagtattcaaggtaccaagggaaaattcaactttaatgattgtgataatcatttaaagaaagctcaagaattaggtatggatttcagaggtcatgctttagtttggcatagtatggccccaaaatggcttgaaaacgaagatgcaaatactatgaaaaactctataattaatcatattactactgtattaaagcattatgaaggaaaaattgatacttgggatgtagttaatgaagctattgatgatagttctaatggtaatggatggaatatgcgtaaatccttcctttacaataaagttccaaactttattgatattgctttccaaactgctcgtcaagtatctccaaaaactaaacttttctataatgattataatactgaaggtatttggggaaagagtgaatctgtttaccaatttgttgctgatttaaagaaacgtaatattccaattgatggtgttggtattcaatatcacgttagtcttgaaaataatccacgtttcgacaaaattaatgatttaattagtcgttattgtaaattaggtgttgaagttcacattactgaaatggatgtcagttgtgacaaaaactgttgggccagtgatgttgaacaacaacaaggtaaagtttttactaatgctttacaagcttgtcttaacaattcttgttgtaccggtttccttgtttggggtattggtgataacgatagttggattggtggtgataagaaaggtttacttttcaattccaattaccaaccaaagtctcaatacactgctgtcttaaatctcttaaaatctactac

SEQ ID NO: 25095 - DNA, 1053 bp, Neocallimastix californiae; identical to SEQ ID NO: 13734
  Glyco_hydro_catalytic_dom

SEQ ID NO: 25096 - DNA, 762 bp, Neocallimastix californiae
  Glyco_hydro_catalytic_dom
ttcccaatcgggtattgaaggtttatgtaaaaattcaaaattatcaaaatcaatcattgtttactatccagaatggaagtattacgatttcccaccaaagaatattccatttaataagcttactcatataaattatgcgtttgccgaaattgattcaaatgattattcattagattatgattcaagtagatttttagaattagttgaaactgctcatgaaaaaaataaaaatattaaagttttaatgtccattggtggctggacaggtagtaagtattactcaaaaatggcatcttcttcttctcgacgatcaaaatttgttaagagtgtgaaaagaatgttggaagcaagtgatgcagatggtattgatattgattgggaatatccaggtacaagtggtgcttatgatgataattttgatgctgaaaatgatacaaataatttattgaaattgttaaaggaattacgtgaagctattggttcttcaaaaattatttctgctgctgttccatttaatacatttgaagtggactctcgtccattaaaagatatgtctgaatttgctgaattgtttgactatgttaatattatggcttacgattttgctggaagttggtcaaccgttacatctcatcaatcttcactgtattcaatttcagaagatgataatggctattctttatctggtgcggtaagtaactggataaatgctaatttcccttcaagtaaaattgttgttggtattcctgcttatggaagatc

SEQ ID NO: 25097 - DNA, 135 bp, Neocallimastix californiae
  Glyco_hydro_catalytic_dom
atctcttaaagccgattacgttataaataaaaatttaggtggaatgatgatgtgggaaattgaagaagatacacaagatagtgaattaatttcaactatttatgaaaagtttatcagtttgacttgtaatgaagc

SEQ ID NO: 25098 - DNA, 120 bp, Neocallimastix californiae
  Glyco_hydro_catalytic_dom
atcaattaaagctgattatgttataaaatataacttaggtggaatgatgatgtgggaaatcgaagaggatacaaaagatagtgaattaatttcaactattcataaaaaatttaaaagctt

SEQ ID NO: 25099 - DNA, 738 bp, Neocallimastix californiae
  Glyco_hydro_catalytic_dom
agaagaatgcaaaaatttatcaaaatcaataattgtgtattatccagaatggaagtattataattttccaccaaagaatattccatttaataaacttactcatataaattatgcatttgctgaaattaattcaagtgattattccttagaatatgattcaagtaaatttttagaattagttgaaactgcacatgaatataataaaaatattaaggtattaatgtcaattggtggttggacaggtagtagatattattcaaaaatggcatcctcttcttctaatagatcaaaatttgttaaaagtgtaaaaagaatgctagaagctagtggtgctgatggtatagatattgattgggaatatccaggaacaagtggtgcttatgatgataacttcgatgctaaaaatgatacaaataatttattaaaattattgcaagaattacgtgcctcaattggttattcaaaaattatttctgctgctgtaccatacaacacatttgaagttaattataaaccattagaagatatgtctgaatttgctgaattatttgactatattaatattatggcttatgatttcgctggtagttggtcatctgttacatcacatcattcttcactttattcaactgttgaagatgacagtggatattcattagcaggtgctgttaaaaattggatgaacgcaagattcccagctactaaaattgttgttggtattcctgcttatggtagatc

SEQ ID NO: 25100 - DNA, 927 bp, Neocallimastix californiae
  Glyco_hydro_catalytic_dom
tctaacaaatccaaattcaacttcttcaaccaaattattatataattatcttgtgaataattttgggaaaaaaataatatcaggacaagttggttctgcaggatatttagaaactgaagaattcgattatataaaaaaaattactggaaaaactccagcaatgttcaatgttgactttatttttgaatctctagatcatgactggaaaccagatgatagtattgctgatatggttttagcttggtggaagaaatatgaaggaaaaggaatattacatgctcagtggcattggaataaaaaaggaagtgatggtcaagttagtttctatactaaaaatgttgatttcgatataactaaagctctaattgaaggtaccaatgaatataaaagtattatggcagatatggattatattgcttcacaaataaaaatactacaagacaaagatattccaattatttggagaccattacatgaagcttctggaggttggttttggtggggtgctaaaggtcccgaaccatgtgtagcgctgtataaaatgatgtatgaaagatttaccaaagttcataaattgaataatttaatatggtgttggaatggaggaattggtaattggtacccaggagatgaatatgtcgacataatctcagaagatgtttatgataaacatagttcatttgcctcaaaatataattctttacttaatcaagtaggaaataaaaaaattattgcattatctgaaaatggtagtttacctgatattgaatcttgtatgaaagagagaattacctggagtttcttttgtacctggaataatgaatatattttaaataatagtgataatatctataatactcctgaatatattaaaagtgtttataacagtaactatgttattactcaatcagatttaccatcttttgc

SEQ ID NO: 25101 - DNA, 420 bp, Neocallimastix californiae
  Glyco_hydro_catalytic_dom
ggaaaaatggttagaattagttagacaattcattcgtgataaaaaggcttctggtttaacaaattggtatggttatgaaatttggaatgaagctgaaaatacttggagagattctaatggctatactttcttagaattttggaaagaaacttataaggtcattcgtgaaatggatccagatgaaaaaattattggtccatgtgatggtttatacgttgaaagtagaatgcgtccatttttggaattttgtaaagaaaatgatgttatgccagatatcatgtgttggcatgaattaatgggtgttgaattaattccaagaagatataaggcttatcgtgaattagaacgttctcttggtattaaagaacttccaattactattaatgaatattgtgatattaaacatgaattagaaggtca

SEQ ID NO: 25102 - DNA, 291 bp, Neocallimastix californiae
  Glyco_hydro_catalytic_dom
ttactgtaaacttggtcttgaagttcatattactgaacttgatgttaaatgtgataatgtttgtaattctggtaatgttgaacaacaacaagctactgtatttactaatgctcttaaagcttgtcttaataatagttgttgtactggttatcttgtttggggtattggtgataatgatagttggttaggtggtgataagaagggattactcttcaattcccaatacaaaccaaaatctcaatacactgctgttcttaatgttcttaaagaatacagtgcttctcaaccaag

SEQ ID NO: 25103 - DNA, 1047 bp, Neocallimastix californiae
  Glyco_hydro_catalytic_dom
atttagaatgggtgttggaattaatggcagtttaagaaaaacatcaactattctttctaagaaaatggttgatataataaatcatcaatttaatagtgtaacattaacaaacttaatgaaaccttcgtatttactagatcaaaatggaagtcaaaaaaatattatgaaaggaatacaagatccatcagtaaatttccaatcggcaatagatactttagaatattgtaaaaagaataatataaaaatgagaggacatactttagtatggcacactcaaacaccatcatggttctttaaaaaagattatgatgataaaaatgattatgttgattctgaagtaatggaattgcgtatagaaagttatataaaacaggttatgcaattcgttcaatattattatccaggcgttgtagatgtatgggatgttgttaatgaagcggttgaaattgatgaaggatactatgatgaaaaagtatcatggaaaactcgaacaaaatgtaatgaatcatccaatccttggtatgaaacaatgggtcctgattatgtaattaaagcatttagatttgctagaaaatatgcagctcctggtgttaaattaatatataatgattataatacttttatgagtgaaaagacaacagcaattattaatctcttaaaaattttaaaagaagaaaatttaattgatggaattggaatgcaatcatatcttaccccaacttttccagaacgaagtacatatgctaatgctattaagaaattcggtgaattaggaatagaagtacaaattactgaattaactataagcattgatgataaattatcagaagaagagatgtatgaaaaacaagctgaacaatataaggaggtttttgaaatatatcttaaagcgtatcataatggtattaatattggaagtgttactgtatttggtttacaagatggctacctattttataccaatgattcaacgaaaactcgtttatgggataaagatttacaaaaaaagaagaattattattcaattttggaagttttaaaagagta

SEQ ID NO: 25104 - DNA, 930 bp, Neocallimastix californiae
  Glyco_hydro_catalytic_dom
agactactcaaagggtttcagaattggtgcagctactaacacaattcactacaacaatgctaactacgttaatgctatgaaggcattcaactatatggttgctgaaaatgcttgtaaatttgttagtattcaaggtactaaaggtaaattcaactttaatgattgtgatgctcacttaaataaggctaaacaattaggtatggatttcagaggtcacgctttaatttggcacagtatggctccaaaatggcttgaaaatgaagattccaatagtatgaaaaattctattgttaaccatattacaaatgtcttaaaacactacgaaggaaaaattgatacatgggatgtagttaatgaagctattgatgatagttctaatggtaatggctggaaaatgcgtaattccttcctttaccaaaaggttccaaatttcattgatctttctttccaaaccgctcgtaaagtttctccaaaaactaaacttttctataacgattataatactgaaggtatttggggaaagagtgaatcggtttaccaatttattgctgatttaaagaagcgtaatattcctattgatggtgttggtcttcaataccacgttagtgtccaacatcaaccacaattcaataagattaatgatttaattggacgttactgtaaattaggtgttgaagttcatattactgaattagatgtcagttgtgttgaatcctgttatgctggtgatgttgaaaagaaacaatctgatgtctttactaatgccttaaaggcttgtcttggtaattcatgttgtactggatttcttgtttggggtattggtgatccagatagttggttaggtagtgataagaagggcttacttttcaatagtaattaccaaccaaaatcacaatacacggctgtattaaatgtcttaaagactactac

SEQ ID NO: 25105 - DNA, 681 bp, Neocallimastix californiae
  Glyco_hydro_catalytic_dom
agaagttaaggaatactaccttgactatgttgctaaagttttagatcactacaaagatgaagaagatattatttactgggatgttatcaatgaatctgttactgatgattctactgttgataacattaagttacgttatggttctgatgacagtaatgaattcaagggatgggatacttatactgaagatatcttcaaggttgcccgtgaacacactaataaaaatgtaaaattattctataatgattataatgctgaaaacaacaacggtaattacaatggtaagactggtgccgttttcaattacatcaaatctatgagagaaaaagatgttccaattgatggtgttggtttacaaatgcacatttcttgtaattattatccaaactatgatcaactttatgaattaatttctcaatatgaagaaattggtgttgaagttcacattactgaaattgatgtcagtatgaagagttgtagtactcttgaagatcaaaagaaattatatatggatgtctttaaggcttgtttcgatcactctaactgtaaggtctttactgtttggggtgcttacgattctgaatcttgggttggtgctgaaaatgttccattaattttcgatgaagatatgtatccaaaggatatctatttcgatatgttagattatgttatgaaacaatt

SEQ ID NO: 25106 - DNA, 882 bp, Neocallimastix californiae
  Glyco_hydro_catalytic_dom
aattactattaatggtaaacgtcttcttcttaaaggtgttaaccgtcacgatactgatccattcaatggtaaagctattccacaagccactatggaaatggatattactcttatgaaaactaacaacattaatgctattagaacttctcactacagtaatgattcttacttatactggctttgtaacaaatatggtatgtatgtcatgggtgaaactaatatggaatctcatgctttaatggataataatgatgctaaagctttattctatgaagttggtcttgacagaactgaaactgcttataaacgtttaaagaatcatccatctattgttgcttggtctattggtaatgaaatggcttatactagtaatccaagtgatgctggaggtcttttccgtgatatgatttggtatttcaagaagaatgataacagtcgtccagttcatagtgaaggtcaaggtggtagtatgggtgttgatatgtctagtaatatgtacccaagttcagatggtattcgtggtaacgctggtaaaggtaaaatgccatacgttatgtgtgaatatgaccacgctatgggtaattctgttggtgctttaaaagaatactgggatggtattagaagtgctgataatatgcttggtggtttcatttgggattgggttgatcaatctagagctactccattaaaaggtggttgggattattattctgaatcctatgctaaaacaaatctttacgctgaagaaattaaaggtaaattctatggttatggtggtgattggggagattggccaaatgataacagtttctgtgttaatggtcttattagtcctgatagaactccacaaccagaacttgctgaagttaaataccaatacca

SEQ ID NO: 25107 - DNA, 666 bp, Neocallimastix californiae
  Glyco_hydro_catalytic_dom
agctcaaactccaggagctttagtttctgtagatttagctgatattttaccatactggccatatcaatttaaaggtattcaaagttggttaaatgatattggttcatttattgatgataaaaaagcttcaggtttaactaattggtatggttatgaaatttggaacgaaccagatggtacatggaaagattccaatggtatgaactttaatgaattttggaaacaaacttatcaatttattcgtcaaaaagatccaaatgaaaaaattattggtccatgtattagttggtataatgaaaataatattcgttctttcttacaattcgctaaagctaacaattgtcttccagatattattagttggcatgaattaagtggtattgatggtatgtcttcacatttcagatcttatcgtaatttagaaaaatctcttggtattaaggaacttccaattagtatcaatgaatactgtgatgctgaacatgaattagaaggtcaaccaggttcaagtgctcgttttattggtaaatttgaacgttataagattgatacagctatgattacttggtggtttgttccacaaccaggtcgtttaggtagtttaatggctactgatactcaaaagggtgctggttggtatttctataaatggtatggtgatatgac

SEQ ID NO: 25108 - DNA, 426 bp, Neocallimastix californiae
  Glyco_hydro_catalytic_dom
ttgtactgaaaattcattcaacaacttcattttcccagaagatgatgataaggttattgcagccgtacatgcttactctccatataactttgccttaaacaatggtgatggagctgttgatacttttgattcagctggtaagaacgaacttgattggaacattaacttaatgaaaaagagattcgttgatcaaggtattccaatgattcttggtgaatatggtgctatgaaccgtgataatgaagaagaacgtgccaaatgggccgaatattacatggaaaaggttacagctttaggtattccacaagtttggtgggataatggtatctttgaaggagaaggtgaacgttttggtattattgaccgtacttccttaaagattatgtatccagatattgttgcttcattacaaaagggtagaggttt

SEQ ID NO: 25109 - DNA, 927 bp, Anaeromyces robustus; identical to SEQ ID NO: 25094
  Glyco_hydro_catalytic_dom

SEQ ID NO: 25110 - DNA, 483 bp, Anaeromyces robustus
  Glyco_hydro_catalytic_dom
atcacgtactccaggtgctttagtatctgttattttaaccgatttcttaccatattggccttatcaatggccaggtatggaaaaatggttagaattagttagacaattcattcgtgataaaaaggcttctggtttaacaaattggtatggttatgaaatttggaatgaagctgaaaatacttggagagattctaatggctatactttcttagaattttggaaagaaacttataaggtcattcgtgaaatggatccagatgaaaaaattattggtccatgtgatggtttatacgttgaaagtagaatgcgtccatttttggaattttgtaaagaaaatgatgttatgccagatatcatgtgttggcatgaattaatgggtgttgaattaattccaagaagatataaggcttatcgtgaattagaacgttctcttggtattaaagaacttccaattactattaatgaatattgtgatattaaaca

SEQ ID NO: 25111 - DNA, 957 bp, Anaeromyces robustus
  Glyco_hydro_catalytic_dom
tcaacaagtcagaccagatttttactttggtgttgccactactaaatctttcttcgctaatccaaaatacaaagatattatgagtacttataatttacaagttggtggtaatgaatgtaagttttacactttccaaggtactgaaactttcaacacaaaaccttgtgatgacagtattgcttttgctaagaaattaggtgccaaattccgtggtcacaatcttttctggccagcttactctccatcatggttcaaaacttacagtagtgatattgaagaagttaaggaatactaccttgactatgttgctaaagttttagatcactacaaagatgaagaagatattatttactgggatgttatcaatgaatctgttactgatgattctactgttgataacattaagttacgttatggttctgatgacagtaatgaattcaagggatgggatacttatactgaagatatcttcaaggttgcccgtgaacacactaataaaaatgtaaaattattctataatgattataatgctgaaaacaacaacggtaattacaatggtaagactggtgccgttttcaattacatcaaatctatgagagaaaaagatgttccaattgatggtgttggtttacaaatgcacatttcttgtaattattatccaaactatgatcaactttatgaattaatttctcaatatgaagaaattggtgttgaagttcacattactgaaattgatgtcagtatgaagagttgtagtactcttgaagatcaaaagaaattatatatggatgtctttaaggcttgtttcgatcactctaactgtaaggtctttactgtttggggtgcttacgattctgaatcttgggttggtgctgaaaatgttccattaattttcgatgaagatatgtatccaaaggatatctatttcgatatgttagattatgttatgaaacaatt

SEQ ID NO: 25112 - DNA, 945 bp, Anaeromyces robustus
  Glyco_hydro_catalytic_dom
agactatgctaacggtttcagaattggtgctgctactaatactatgcattataataatcaaaactatgttaatgctatgaaatctttcaattatatggtagctgaaaatgcttgtaaactttctggtattcaacaacaaaaaggtgtttacaatttcaatgattgtgataatcattataagaaggctaaagaattaggtatggacttccgtggtcactgtcttatttggcatgcctatcaaccatcatggttccaaaatgctgatgctaacacattaaagaacgctattgttgatcacattactaaggtacttcaacattatgatggtaaaattgatgcctgggatgttgttaatgaagctattgatgatagttctaatggtaatggatggaagatgcgtaattccttcctttaccaaaaggttccaaactttattgatttagctttccaaactgctcgtaaagttgctccaaatgttaaacttttctataatgattataatactgaaggtgtttacgctaaaactgaatctgtttatcaatttattcaagatatgattaaacgtaatattccaattgatggtgttggtattcaatatcacgttgctgttaatcaacaaccatcttaccaaaagattaatgatttaattggtcgttactgtaaacttggtcttgaagttcatattactgaacttgatgttaaatgtgataatgtttgtaattctggtaatgttgaacaacaacaagctactgtatttactaatgctcttaaagcttgtcttaataatagttgttgtactggttatcttgtttggggtattggtgataatgatagttggttaggtggtgataagaagggattactcttcaattcccaatacaaaccaaaatctcaatacactgctgttcttaatgttcttaaagaatacagtgcttctcaaccaag

SEQ ID NO: 25113 - DNA, 129 bp, Anaeromyces robustus
  Glyco_hydro_catalytic_dom
tattccacaagtttggtgggataatggtatctttgaaggagaaggtgaacgttttggtattattgaccgtacttccttaaagattatgtatccagatattgttgcttcattacaaaagggtagaggttt

SEQ ID NO: 25114 - DNA, 1038 bp, Anaeromyces robustus
  Glyco_hydro_catalytic_dom
aggttacctttcaactaaaggtagatatattgttgacgaaaaaggtcgtaaagttaaattagctggtatatcttggtttggtggtgaaactactaacctttcaccacacggtttatgggctaagccattatctcacttcattaaaattattaaggatcttggttataaccatattcgttacccatggactaatgaaatgctcttcccaggtgccaaaactcaatctgttgatcaattacaaaatccagatcttgctgatcttactccattagaagttatggatgctgttattgatgcttgtggtaaagctggtattaaggtttatctcgatcgtcacagacctctttctggtggacaaagtgaattatggtatgttgctaaagtagatgaagataaatggattgaagactggcaattccttgctaagcgttacaagggtaatccaactgttattggtgctgatcttcacaatgaaccacatggtactgcttgttggggatgtggtgaaactaaacgtgattggagacttgctgctgaaagatgtggtaatgccatccataaagttaacccagattggcttattattgttgaaggtaatgatcactatggtgaagaaggttggcaaaagggagaaggatactggtggggtggtatgttaaagggtgttaaggaaaacccagtaagattaaataccccaaacaaacttgtttactctgctcatgattatgataagaatgtattcatgcaagattggtttaaagtttctaacttcccagacaacatgccagaaatttgggatgataaatggggttacattgctaaagaagacattgcaccagtacttattggtgaattcggttctcttttaatggataataaagatgttaaatggttacaaaatttaatttcttacatgaacaagaatgatgttcactggactttctggtgtttaaatccaaattccggtgatactgaaggtattcttggttatgattggacaactgttaatactaagaaagataatattcttactccagg

SEQ ID NO: 25115 - DNA, 666 bp, Anaeromyces robustus; identical to SEQ ID NO: 25107
  Glyco_hydro_catalytic_dom

SEQ ID NO: 25116 - DNA, 924 bp, Anaeromyces robustus; identical to SEQ ID NO: 13759
  Glyco_hydro_catalytic_dom

SEQ ID NO: 25117 - DNA, 669 bp, Anaeromyces robustus
  Glyco_hydro_catalytic_dom
tttatcacgtactccaggtgctttagtatctgttgatttagctgatattttaccatactggccttataaatggccaggtatgcaaaaatggttagatgaagttagatcatttattcgtgataaaaaggcttctggtttaacaaattggtatggttatgaaatttggaatgaagctgaaaatacttggagagattctaatggttataactttttagaattctggaaagaaacttataaggtcattcgtgaaatggatccagatgaaaaaattattggtccatgtgatggtttatatagtgaagaaagaatgcgtccatttttacaattttgtaaagaaaataatgtattaccagatattatgtgctggcacgaattaatgggtgttgaattaattccaagaagacaaaaagcttatcgtgaattagaacgttctcttggtattaaagaacttccaattactattaatgaatactgtgatgttgaacatgaattagaaggtcaaccaggttcaagtgctcgttttattggtaaatttgaacgttataatgttgaaagtgctttaatttcttggtggttcgttccacaaccaggtcgtttaggtagtttattagctactgattctaaaaagggtgctggttggtatttctacaaatggtatagtgatatgac

SEQ ID NO: 25118 - DNA, 1047 bp, Anaeromyces robustus; identical to SEQ ID NO: 13761
  Glyco_hydro_catalytic_dom

SEQ ID NO: 25119 - DNA, 1035 bp, Anaeromyces robustus
  Glyco_hydro_catalytic_dom
aataggtttcctttctactaagggtcaccttattgttgatgaaaagggtcgtgctgttaaattagctggtatttcatggttcggtggtgaaactactaacctttctccacacggtttatgggctaaaccattaagtcatttcattaaaactattaaggatcttggttataaccatattcgttacccatggactaatgaaatgtttaaagaaggagctaaaactgaatctgttgattccgtcaataacccagatcttgctgatttaactccattagaagttatggatgctgttattgaagctgctggtgctgctggtattaaggtttaccttgatcgtcacagaccacttgctggtggacaaagtgaattatggtacattgatgaagttccagaatctcaatggattgaagactggcaattccttgctaaacgttacaagggtaacccaactgttattggtgctgatcttcataatgaaccacacggtaccgcttgttggggttgtggtgaagaagttcgtgattggagacttgctgctgaaagatgtggtaatgctattcatgaagttaacccagactggcttattattgttgaaggtaatgatcactatggtgaagaaggatggcaaaagggtgaaagttactggtggggaggtatgttaaagggtgttaaggaaaacccagttagattgaaggttccaaacaagcttgtttactctgcccacgattacgataagaatgttcacttacaagattggttcactacttctgatttcccagacaacatgccagaaatttgggatgataaatggggttacattgttaaggaagatattgctccagttcttattggtgaatttggttcagtcttaagagatgctgttgatgttaaatggttaactaatttagttacctatatgcatgaaaatggtgtccactggactttctggtgtttaaatccaaactctggtgatactgaaggtattcttggatacgattgggaaactgttaatactaaaaaggatggtatccttac

SEQ ID NO: 25120 - DNA, 927 bp, Anaeromyces robustus
  Glyco_hydro_catalytic_dom
aactttagttaatccaaaagctattcctgctgctaaaaaactttatgatttcttaaaaacaaattatggtaaaagaattttatctggtcaagttggtgctgctggtcaagccggtgatgaaggtgaagaatttaaacgtattattaatgctactggtaaaaaaccagctgtttggaatatggatttcatttttgaatctaatgattgtacttggagaccaactaaccctgatattactgaaatggcacttgattggtggaaaaaatatcaaggtaagggtattatgtctgctcaatggcattggaatattgctggtcaaactggtaattttgctttttataaaaaagatactacttttgatttagaaaaagctgttaccgaaggtacttgggaatataataaaattataaaagatattgatcgtgtttctggtcttattaaaaaattacaagctgttaatatgccattactttggcgtccacttcatgaaaataatggtgattggttctggtggggaaataatccaaaagcttgtgctaaattatggaaaattttatatgaacgtatggttaattatcacggattaaataatttaatttggctttggaatggtaataatgatgaatacactccaattgaatatatcgatttaattggtgttgatatttatgctgatgaccatggaccacaaactactgcttttaatactcattttgatttctatgatggaaagaaaatggttgttttatctgaaaatggtcgtattccagatattcaaaaatgtgttgcacaaggagcatggtggggttacttccaaacttggaatagtgaatttatattacaagattcctaccatactacagctcaacttaaagaatactttagcaataaagtcgttatgaatatggatgaacttccatcatttaa

SEQ ID NO: 25121 - DNA, 73 bp, Anaeromyces robustus
  Glyco_hydro_catalytic_dom
aattcgtgatatttcttcaaaagaattaattaaagaaatgaactttggttggagtttaggtaatactttagat

SEQ ID NO: 25122 - DNA, 36 bp, Anaeromyces robustus
  Glyco_hydro_catalytic_dom
tttagcttgtgcaattgctactgcaagcgcttcaga

SEQ ID NO: 25123 - DNA, 1050 bp, Anaeromyces robustus
  Glyco_hydro_catalytic_dom
tactttagcagctgctagttcagctttagctttaacttctcaagaagttgttaatgaaatgggtctcggttggaatttaggtaatactttagaagcttttggtgattggataaatggtagtacagttaatcaatttgaaactgcttggggtaatccagcagcaacaaaacaattaattactgcaattaaaaattctggtttcaatagtattcgtattccagttgcctggagtaatcttatgagttctgattacactattagttcagaattattaaaaagagttaatgaagttgttagttgggttattgatagtaacatgtatgctattattaacattcactacgatggaggttggattgaaaaattcggtactagtgaatctactatggctaataataaattcaataaaatttggactcaagttgccgactatttcaaaaactatggtgaacatttaattttcgaatcattaaatgaagaaggttgttggaacgatgtttggaatcgttatagtaactctggtgataaaaacaaggcttactctactttaaataacattaaccaacaatttgttgatattgtacgtaaatctggtggtaacaacaaatccagacatttacttatagctggttattgtaccgatattgacttaactgtcgattcagctttcaaaatgccaactgattctgccaatagaatgatggtttctgttcactattacactccatctactttcactattcttgaaaaggatgaaagttggggtaaatttgctggtacttggggtactgatgctgaagttaatgcccttcttgctgatttcgataaacttaagaaacgttttgttgataatggtgttccagttattattggtgaatatggtaccgttttaactaacaaagataaggacagtgttcacaaatacttattcacttgtgctcaatatgctacaagtttaggtatgtgtccaatgctttgggataatggtgatcactttgaccgtaaaggacttaaattcaaggattctgaagttggtgatttctacaaata

SEQ ID NO: 25124 - DNA, 915 bp, Anaeromyces robustus
  Glyco_hydro_catalytic_dom
atatactggtgttaacgaatccggtgctgaattcggtcaaggtaaatatccaggtgaatacaataaagattatatttacccagatgttaaagcaattcaagcttcaattgatcaaggtatgaatgttttccgtattggtttttcatgggaacgtttacaaagaagtttaaatgctgaacttgattcaactgaatttgatcgtttagatgaagttgttagttatgttactaaaaatggtgctgtagctattcttaatccacacaattttgctagatataacggtcaaattgttggtacaagtcaagtaccaaattctgctttcgctgatttatggaaaagaattgctcaaaaatataagagtaataataaagtttggtttggtttagttaatgaaccacatgatatgccaactgctcaatggttctcagctgctcgtgatgctgttgatagtattcgtgctcttggtgctaataataatgttcttgtaccaggtaatgcttatactggtgcttggaattggaaagaaactttttatggagattctaatgcttctacagctcttatatatttcagttcttctgataaaaatattatttttgaaactcatcaatatttcgattctgattattcaggtactcataaagaatgtgttcaacgtccatgtaataaccttttcaaaaacttcgtagaatggttaaaagctaataatttaaaaggttttattggtgaattaggtgctgctattaatgatgattgtaaagcatgtgttgaagaagctattacttatttagaacaaaattctgattatattgttggttgggcctggtgggctgctggtccatggtggcaagattatatgtattctattgaaccaaaaggtgaaagattcccagaacaaatgacttggttaaaacc

SEQ ID NO: 25125 - DNA, 1119 bp, Anaeromyces robustus
  Glyco_hydro_catalytic_dom
tttttataaaggtgttgatatatctagtattatttcattagaaaatagtggtgtaaaattttataatcctttaggtcaagaacaagatctcttccaaattcttgccaatgttggtgtaaattgtattcgtgttagaatttggaattcaccaaagaatgccaatggaaaaacatatggtggtggtggtaatgatcttgaagttgcaagagccattggtagtagagctgctcgttatggtctttcattatttgttaatttccattattctgatttctgggctgatccatcaaaacaaactattccaaaagaatggaaaaattttgaccttgataaacgtatttttgaaatttacagatttactaaaggatgtttagaatggcttttagaaaatggttcaattatttctatggttcaaattggtaatgaaactactagttttatgtgtggtgaaaagaatatgactaatgtaatgaaaatgatgagtaatggtgttaaagctgttcgtgatattagcaagaatatagtagttgctcttcattttactaatccaaataaagctgatactatgttatggtatgcttctcaacttgcctctgctagagttgattatgatgtatttgccacttcatattatccatactggcatggtacccttgataatttaaagggagtattaaataaaatagctaaccaatatggtaagaaagttctcattgctgaatattcttatccatacacaaacgctgctttaactgatgatagatgtcattatgaattaatttcatctagtacaagtaatatccaactccgttatccagttagtattgacggtcaaattcaaagtattagagatatttacaaaactattaaagaaattaaaaatggtattggtgctttctattgggaaccagcttggattgctccaaaggcaagaaatgatgccgaaagaaaacaaatttgggaaaagtatggttctggttgggcaagtactcctgctgctgaatatgatagtgatgttgatagatatcaaactggtggaactacatgggataatcaagctgtttttacacaaaatggtaaaccattagattcactttatgcattaggagagataactgc

SEQ ID NO: 25126 - DNA, 1089 bp, Anaeromyces robustus
  Glyco_hydro_catalytic_dom
atttgaaggtttcggtacaagtttctgttggtgggctaatcgacttggttattctgattctttatctgaaaaagcagctactctattttatgataaagaaaaaggtttaggtcttactgttattcgttataatatcggtggtggtgatgatccaactcataatcatattactagaacagattctaacatgccaggttatgctattaatccaaaatacgatggtagatcttacacttgggattataattggaatagtgatagtaatcaaagaaatgttttattaaaatctgtagctaagaataaagatgaaattattgtggaagcattctctaattctcctccatattttatgacatattctggttgttctactggtaattttgatccaggtaaagataatcttagaagtgatgcttatccagctttcgctaaatatcttgctgatgttgctgaacatttcaaaactcattggggtgtttatttccaaagtattactcctactaatgaaccatacactaatttctggggagcaaatagttataaacaagaaggttgtcattttgatcaaggagaatctgaatcaaaaattattgttgaacttcgtaaagctattgatcaaaaaggattaaaagaaatgcaaattagtggtacagatgaaactagtattgatactcaaattacttcttttgaaaaacttagtaatgaagctaaaaatattattacaagaattgatactcatacatatggtggatggaaacgtgatgaattaagacttcttgctgaaaataatcataaaaacctttggatgtctgaagttgatggtaaaggtactgaaggtactaatgccggtgaaatgggtgcagctatttggttagctaatcgtattataggtgatttaaatggtcttagagcctctgcttgggttctttggcaagttattgataatcatattagtaaaaatggttataatggcagaaaagattctggtatgataaatattaatgaaggttactggggagttgccgttgctgatcatgataatgataatattattcttactcaaaaatattatggttttggtcaattcag

SEQ ID NO: 25127 - DNA, 1050 bp, Anaeromyces robustus
  Glyco_hydro_catalytic_dom
attccgtatgggtgtaggattaaacggtggtaatattagcaattatactccaagttctaagaaaatgatggaacttattaattatcaatttaattctatgacttactctaatggtatgaaatcactttttattatggatcaagaaaagtcacttaagaacttagcagaaggtaaagaagaagttggtataaatttctcaggagttatagatggtttagaattttcagctaaaaataatcttaatattagaggacatgttttagtttggcataagcaaactccagaatggttttggagaaaagattttgatgaaactaaagaatatgtcgatcgtgaaactattttcaagcgtttagatagtttcatgaaaaattattttgatttcttaaatttcaactacccaggtgttgtagatgttgttgatgttgttaatgaagctgttgaagttcttgaaggaaaatatgataattctactggttggtacactcgtacagaatcatatgaaggtgatgaaaacatttggtataacttagttggaccagattatgttaaggaagctttccgtattgctcgtaaatatgcacttccaaccactaaattagtttataatgattatgatacttggagaactactcctcatgataaaactgaagctattattaatcttatgaaaatattaaaagctgaagatttagttgatgttattggtatggaatcttatattactccaggtgaaccaactccagaagaatatggtaaagctattgaacgttatgctgctgaaggattagaaattcaaattactgaatttactatttatgttactgatggtgatgattggttagaacaacaaaccattcattatcgtgatatgttcaaagctattatggaagcttataaaaagggagctaatattactagtttcactgttttcggtttacaagatggttatagattctatgatagtgatagtactagaactcgtttatatgaccacgatcttcaaaagaaaccaaacttccaagctattatggatatcttaaaggaata

SEQ ID NO: 25128 - DNA, 609 bp, Anaeromyces robustus
  Glyco_hydro_catalytic_dom
accaggttggccatatcaatttaaaagtatgcaacattggaaagatgaaattaaatcttttgttaatgataaaaaagcttctggtttaactaattggtatggttatgaaatttggaatgaaccagatggtacatggaaagatcctaatggattaaactttaatgaattttggaaacaaacttatcaataccttcgtcaaattgatccaaatgaaaaaattattggtccagctttaagttggtataatgaagatagaattcgttctttcttacaatatgctaaagctaataattgtcttccagatattatttgttggcatgaattaagtggtattgataatatgtctgcacattttagatcttatcgtaatttagaaaaatctcttggtattaaggaacttccaattagtattaatgaatattgtgatgctgaacattcattagaaggtcaaccaggttcaagtgctcgttttattggtaaatttgaacgttacaagattgatagtgctatgattacttggtggtttgtaccattaccaggtcgtttaggtagtttaatggcttctgatactcaaaagggagctggttggtatttatataaatggtatgg

SEQ ID NO: 25129 - DNA, 981 bp, Anaeromyces robustus
  Glyco_hydro_catalytic_dom
aacaactaaagagttcatgaaatctattggtatgggtgttaatataggacatacttttgatacaataagagattggtctaatattgacatttcagaaattaatagtgattttaaactttggactgattctgaagtaaaaattaaggaagctgtagaaggttataaaaatttaggttttcattccattcgtatacctgtaaaatggtcaactcgtccaacaactaaaacaccaattgaaccaaaattattaaaagcagtagaagaagttgttcgagtagctattgaaaatgatatgtatgttattattaatttagaaacagataatttttatatgaatggatttatttcagaagataaagctattcttactgaaacttatgatagttataaaggaacttggaaacaaatcgctaattattttaaagattatgatgaacatttaatgtttgaagcattaaatgaatcaggttattgggaaactatatggaatactcgtacagctgatggtgatagacctgaagctctcgctgttttacttaaagtcaatcaagaatttataaataccgttcgttctattgaaggatataatcaagaaagatatttattaattgaaggttatgcttgtgatccaattttaactcaagatcacttttataaaacacctagtgatccaaaaagttcaggaaaacttattgtttcactttattatttcattccttacacatttactgttatagaaaagtatggtatatggggatcttcatatgatgttcatcaacttcaagaagttgttgatgatctcagatatcgttttgttattcaaggagttccagtcatttttacaagatatggtacaaatattagaaatagaaaaagagaagatattcgtagtttcttaacatctgttgctaatattactacaacaggtgaaataccatctttctttaatgatattggagcattaattgatcgtactcaagt

SEQ ID NO: 25130 - DNA, 966 bp, Anaeromyces robustus
  Glyco_hydro_catalytic_dom
tcatgaaagagttgatttagcccttgaagcttatgctaaacataatcttaatgttgtaagagcttgggctttctgtgatgaatgtgaagatgcaacaagattagttgatttttctggtccagaggttaaacttaatagtgaaaatatggaaaaggttgattattatcttgctgcagctgctcaaagaaatattcgtgttgtattaactcttactaataactggactgattacggtggtatggatgtttgggtcaaacaattcggtggaaaatatcatgatgaattctatactaatagaaaacttattgaaggttacaaacaatacattaaagctatgattaaccgtgttaatacttataccggtcaaagatacaaggatgatccaaccattttttcatggcaacttgctaatgaagctcgttgtaataatggacctcatggtcttccagttaaagattgtaatactgatactattactaaatggatggatgaaatagctacatttattcatgaagaagatccaaatcatttggtctcttctggtattgaaggtattggtcttacaccaccggctggtgttgatccaaatacatatgtctatacttacgttgaaggtactgattatgaagccattagtgctcttgattctattgattataacactgttcatatgtacccagttggttggggtttaaaagattatgctaaggatggtgtaaaatggattcaagctcacgctgatgttgataaaaaattcaataaaccaactgttgttgaagaatggggtcttagtacatcagctgataatgtacctttagaagaacgtgatccaatttatactcaatggatggatgctgttttagctaatgataatattggtatgaatatgttctggtatgtttgtggtgaagattattatggaactgatggttatattgtaaaagatgatgaaattactaaagttat

SEQ ID NO: 25131 - DNA, 684 bp, Anaeromyces robustus
  Glyco_hydro_catalytic_dom
taaagtagctcaacgtttatctcaaacccctggtgctgttgtatctgttgattttgctgatattttaccaaattggccttatagatggccaggtttacaaaaatggttagatgaagttaaatcttttattaatgataaaaaaaaatcaggtttaacaaattggtatggttatgaaatttggaatgaacctgatggtacttggaaagatgcggatggtattaattttaatgaattatggagacaaacctatcaagtaatgcgtcaaaatgatcctaatgaaaaaattattggtccttgtgatagttggtataatgaaaatagaatgcgttctttccttcaatatgctaaaactaataattgtttaccagatattatgtgttggcatgaattaagtggtatagaaaatgtttccaatcatttaaaagcttatcgtaatttagaaaaatctcttggtattaaggaacttcctattactattaatgaatattgtgatgctaaacatgaatgggaaggtcaacctggttcaagtgctcgttttattggtaaatttgaacgttataaggttgatagtgctttaatttcttggtggtttgtaccacatccaggtcgtttaggtagtttattagctaccgatacacaaaaaggtgcaggttggtatttttataaatggtatggggatatgac

SEQ ID NO: 25132 - DNA, 930 bp, Anaeromyces robustus
  Glyco_hydro_catalytic_dom
gcttcaatatgttggtgttaatgaagctggtggtgaatttggtgaaaataatttaccaggtatttataataaacattatatttatccaaatattgaatccattcgtgcttctgttgaacaaggtatgaatgttttccgtatgggtcttagatgggaacgtttccaacatgaattatttggtgaatttagtgaatttgatgttactgaatataaaaaggttgttgatgctactacttctatgggagctgtacttatcattgatccacataattatgctcgttacaatgataatattgttggttctaaagaagttccaattgaagcctttgctgatttctgggctaaattagcaaatattttcaaagataatgaaaaagtatggtttggtttagttaatgaaccccatgatatggaaactgatgattggttcaaggcggctcgtgctgcagttgatgctattcgtgccactggtgctactaataatattttaattccaggtaatggatgggatggtgcatggagttggggtaaggaagcttggtatggtgaagctaatgctgatgttgctttaagatatttctcatctgaagataaaaatattatttttgaagttcaccaatactttgatgaagattactctggaactcatgacacttgtattcaacgtccatgtcaaaatcttcttaaagaatttgttgaatggcttaaaactaacaatttaaaaggttgggttggtgaaattggtggtactcttaatgatgaatgtaaagaatgtgttcatgaacttattgaatatcttcaagaaaatagagattatgttttaggtcttcaatggtgggcagctggtccatggtggggacacaattcttactctattgaaccaaattcagaaaaggcttttccaggacaaatggcttggttaaaaccata

SEQ ID NO: 25133 - DNA, 792 bp, Anaeromyces robustus
  Glyco_hydro_catalytic_dom
atttgaaggttttggtacaagtttctgttggtgggctaatcgtcttggttattcagattctttagctgaaaaagctgctactctcttttatgataaagtcaatggtttaggtcttaccgttattcgttataatattggtggtggtgatgatccaactcatcatcatattactagaacagattcaaatatgccaggttatgctattaatccaagatatgatggtagatcatatacttgggattataattggaatagtgatgctaatcaaagaaatgttttattaaaatctgttgctaaaaatagagatgaaattattgtagaagctttctctaattctccaccatactttatgacgaattctggttgttccacaggtaattttgatgctaataaggataatcttaaaagtgatgcttaccctgcttttgctaaatatcttgctgatgttgctgaacatttcaaaacaagttggggtgttggtttccaaagtattacccctgttaatgaacccttcactaattattggggagctaatagtaaaaaacaagaaggttgtcactttgatcaaggtaattctgaatccaaaattattgttgaacttaaaaaagctattgatcaaagaggtttaagagatatgcaaattagtggtacagatgaaactagtattgatactcaaattacttcattccaaaaacttagtaatgaagctaaaaatattattactagaattgatacccatacttatggtggaagtaaacgtgatgaattaagacttcttgctgaaaataataa

SEQ ID NO: 25134 - DNA, 1035 bp, Anaeromyces robustus
  Glyco_hydro_catalytic_dom
aggtttcctttctactaaaggtagatcaatcgttgatcaaaatggtcgtaaaataaagttagctggtatttcatggtttggaggtgaaactaataatctttctccacatggtttatgggctaagccattagatcattttattaaaactattaaggatcttggttataatcatattcgttatccatggacaaatgaaatgcttacaccaggagctaaaacaaattcaattgattctacaagtaatccagatcttgttaatcttactccattagaagttatggatgctgttattaatgcctgtggtaaagttggtcttaaagtttatcttgatcgtcatagacctcaatctggtggacaaagtgaattatggtatattccagaagtagatgaaagtaaatggattgaagattggcaatttcttgctaaacgttacaagggaaatccaactgttattggtgctgatattcataatgaacctcatggtgaagcatgttggggatgtggagaaagtaaacgtgattggaaagctgctgctgaaagatgtggtaatgccattcatcaagttaacccagattggcttattattgttgaaggtaatgatcattatggtgaagaaggttggcaaaagggtgaatcatactggtggggtggtatgttaaagggtgttaaagaaaacccaattaaattaaataaaccaaataaacttgtatattctgctcatgattatgataagaatgttcatatgcaagattggtttaaggaatccaatttcccagataatatgccaaccatttgggatgataaatggggtttcattgctaaacaaaatattgcaccagttcttattggtgaatttggttcccttttaaaagatgcaaccgatagtaaatggttacaaaatttagttacttatatgactaagaatgaaattcattggactttctggtgtttaaatccaaattctggtgatactgaaggtattcttggatatgattgggaaactgttgatactaaaaaagatggtcttcttacacc

SEQ ID NO: 25135 - DNA, 723 bp, Anaeromyces robustus
  Glyco_hydro_catalytic_dom
taaaaaaattgttggttatttcagtgaatggagaaattccaattatccaattagtcgtgtagatttatcaaaaattactcaccttaattatgcatttggtcttattgatccaagtacatatgctgtaaccggttatgaaagttggattttaactcaagttgttgaagctgctcataaacaaggtgttaaagttcttatgtcaattggtggttggtatggaagtcgttacttcactaaaatgacctcttctaagagtaatatggaaagatttgctgatagttgtaaaaatcttattgatacatataaaatcgatggtattgatattgattgggaatatcctggaagagaaggtgcttgtaacacccctgaccttgccaatgatacagataattatttaacacttttagaaattttacgtaagaagattggtaatgattcattaattactgctgctgttagtgcaattccatttgaaaagaatggtcaaccagtttcaaatctttcagcttatgctaaatactttgattttattaaccttatggcatatgattttgctggtagttggtcatcagttacttcacatcattcaggtttatatgatccagaagctggtgataaattatctgtttccactggtgttaaaaattggttaaatgctcaattcccagctagtaagattgttgttggtgttccagcttacggaaagagttggattgctgcttc

SEQ ID NO: 25136 - DNA, 207 bp, Anaeromyces robustus
  Glyco_hydro_catalytic_dom
aattatttcttatgatgatccaaaagctattgaaaacaaagctaaatatgttcttagtaataattttgctggtatgatggtttgggaattagaaaatgatacggaagattttgaaatcttaagtgccattaataagcatttaggttgtgatggttcttttaatggtgattcaaacaaacctactactactactactaaaaaaactac

SEQ ID NO: 25137 - DNA, 738 bp, Anaeromyces robustus
  Glyco_hydro_catalytic_dom
atgtaaaaattcaaaattatcaaaatcaattattgtttattacccagaatggaaatattatgatttcccaccaaaagatatcccattttcaaagttaactcatattaattatgcttttgctgaaattaatcctgatgatttctcattagaatatgattcaaataaatttttagaattaatagatactgctcataaaaaaaataaaagtattaaagttttaatgtcaataggtggttggactggtagtagatatttctcaaaaatggcttcatcttcttcaaatcgtacaaaatttgttaaaagtgtaaaaagaatgattgatgctagtaatgctgatggtattgatattgattgggaatatccaggttcaagtggtgcttatgatgacaattatgattcagaaaatgataccaataatttattaaaattattaaaagaattacgtgaaactataggaacttcaaaacttattactgctgctgtaccatttaacacttttgaagttgatcataaacctttaagtgatatgacagaatttgctaaactttttgattttattaatattatggcttatgatttctctggaagttggtcttccgttactgcacatcaatccgctctttattcaactcatgaagatgatagtggttattccctttcaggtgcagttaaaaattggatgaatgctaatttccctgctaaaaaaattgttgtaggtattccagcttatggtagatc

SEQ ID NO: 25138 - DNA, 117 bp, Anaeromyces robustus
  Glyco_hydro_catalytic_dom
aggtcttaaagctgattatgttattgaaaataatttaggtggtatgatgatgtgggaaattgaagaagattcaaaagatagtgaattaatttcatctatgtatcaaaaattcatttc

SEQ ID NO: 25139 - DNA, 192 bp, Anaeromyces robustus
  Glyco_hydro_catalytic_dom
tgttggtgaaattggtgctgctattaatgataaatgtaaagcttgtgttgaagaaactttaaattatttagaagaaaattcggataatattgttggttgggcttggtgggctgcaggtccttggtggggtaattatatgtattctcttgaaccaaaaggtaaagctttccctgaacaaatgacttggttaaa

SEQ ID NO: 25140 - DNA, 636 bp, Piromyces finnis
  Glyco_hydro_catalytic_dom
gacacaagtttcaagttatttcaaagattttgatgaacatttaatttttgaatcattaaatgaagaaggttgttggaatgatgtttggaaccgttggagtaatgctggtgataagaataaggcatatggaactttaaacaatctcaatcaacaatttgttgatattgttcgtaactccggtggtaataataaaaatagacatttacttttagctggttattgtactgatattgatttaacagttgattctgcctttaagatcccatctgattcttctaatagattaatggtttctgtacactattacactccatctacttttactatccttgaaaaagatgaagattggggtaagtttgctggttcatggggtactgacgctgaagttaaagcccttattgctgatttcgataaacttaaaaaacgttttgttgacaatggaattccagttattattggtgaatacggtacagttttaactaacaaaaataaagacagtgttcacaaatatttattcacttgtgctcaatacgccactagtttaggaatgtgtccaatgctttgggataatggtgatcactttgaccgtaagggtcttaaatttaaggattctgaaataggtgacttctacaaaca

SEQ ID NO: 25141 - DNA, 1053 bp, Piromyces finnis
  Glyco_hydro_catalytic_dom
gccatttcgatttggtgttggtctctatggtaatgatcttgccatgtccaccatcacatctgaaaaaatgagaaaagttattaaatatcaatttaattcaatgacctatactaatcttatgaatccaagtgctattttagatcaacaagcttctattgataatattatgaatggtaatgaagatcctattctaaattttagtaatattgttgatggtttagattttgcctataaaaatggacttaatattcgtggtcatgctctagtatggcatactcaagttccagaatggttctttagagatggatattatagcaatacagaatttgttagtagagatgttatggagtatcgtttagatagttatattcgtaagttccttggatttgttcaatttaattatccaggaacagtagatgtttgggatgtagttaatgaagcaattgaaattacagatggtcaatatgatgaaacaactggatggtatacccgtactgctaataataaaacaccaaatccttggtatgaaatatttggacctgattatgttgcaatagcattccgtattgctcgtaaatatgcccttcctaatgtaaagttaatttataatgatcataatactttccaaatccaaccacatgataaaactcaagccattattgatcttgccaatattttacaacaagaaaacttaattgatggtattggtatgcaatcttatataggagttacttggccaaatttagatgattactttaacggtttagaaaggttaattacttctactggattagaaattcaaattactgaattaacaattactccaccaataggtgataattggttaggtgctcaagcagaacaatattatgagtacttcaatagacttttatcttacattaaaaatggttataacatttctagtgtcactgtttatggtttacaagatggctatagattctacactaaagattctaccaaaactcgtcttttagatcatgatcttaaaaagaaaccaaatttcaatgctattataaatgtattaaaaaatta

SEQ ID NO: 25142 - DNA, 897 bp, Piromyces finnis
  Glyco_hydro_catalytic_dom
tacaaaaaattggcaacctatcactataaatggtaaacgtcttcttcttaagggtgtaaatcgccacgacactgatccattcaatggaaaagctatacctcaagaaactatgcgtgaagatattactttaatgaaaaagaataatattaatgccattagaacttcccactatagtaatgattcctatttatattggctttgtaataaatatggtatgtatgttatgggtgaaacaaatatggaatcacatgctttaatggataataatgatggaaaagctttattctatgaacttggtcttgacagaacagaaacagcatacaaacgtttaaagaataatccttccattgtagcatggtccattggaaatgaaatggcatacacaggtaatccaagtgatgctggaggtcttttccgtgatatgatatggtactacaagaaaaacgataatactcgtccagttcacagtgaaggacaaggtggtggaatgggtgtcgatatgagtagtaatatgtaccctagctcagacggtattcgcggtaatgcaggaaaaggtaaaatgccatatgttatgtgtgaatatgatcacgctatgggtaactcagttggtgctttaaaagaatattgggatgctattagaagtgcggataatatgttaggtggtttcatttgggattgggttgatcaatcaagagcagttccaatcaaaagcggtggatgggattattactctgaatcctatgccaagacaaatctctattctagtgaaattaaaggaaaattctacggttacggtggtgactggggagatagaccaaatgataacagtttctgtgtaaatggacttatcaatcctgatagaactcctcaacctgaacttgctgaagtcaaattcca

SEQ ID NO: 25143 - DNA, 924 bp, Piromyces finnis
  Glyco_hydro_catalytic_dom
attagtaaatccaaaagctattccagctgctagaaagctttatgactttttaaaatctaattatggtaagagaatactttctggtcaagttggtgctgctggtaaagctggtgatgaaggtcaagaattccaacgtattaagaatgcttctggaaaattacctgctgtttggaatatggatttcatttttgaatcaaatgattgtacttggagaccagaaaatccagatattactgaaatggcaattaattggtggaaaaagtatgaaggaaaaggtattatggcagctcaatggcactggaatattgctggtaaaactggtaattttgctttttacagtaaggatacaacatttagtcttgagaatgcagtaactaaaggtacttgggaatatgaaaagattattaaagatattgatcgtgtttcaggtcatataaaaaagttacaagctgttaatatgcctttaatatggagacctctccatgaaaacaatggtgattggttctggtggggtaataatccaaaggcttgtgctaaattatggaaaatcttatatgaacgtatggttaactatcacggtttaaacaatttaatttggctttggaatggtaataatgatgaatatactccagttgactatattgatattattggtgttgatatttatgctaatgaccacggaccacaaactacagcattcaatacccactttgatttctatggaggaaagaaaatggttgttttatcagaaaatggacgtattccagatattcaacaatgcgttgatcaagatgcttggtggggttacttccaaacttggaatagtgaatttattttacaagaatcataccatactaatgcacaacttaaagaatactttaatcatgaaattgttatgaatatggatgaattaccatcatttaa

SEQ ID NO: 25144 - DNA, 588 bp, Piromyces finnis
  Glyco_hydro_catalytic_dom
attaaatgaaccaagaaaagtcggggaccctgttgaatggacaggagatcaagaaggatataactttgttaatgaaatgaatgaagttttcattaaaacaattcgttccactggtggtaataatgctcttcgtcatcttatgattccaccatatgctgctggtgttatggatgcaagtcttaacactttcagagttccaagagatgatgataaaattattgtttcacttcattcctacagtccttataattttgctttaaataatggatctggcgccatttctaatttctatgatggtagtgaaattgattatgtcatgaatactattcatcaaagatatatcagccaaaatattcctgttattattggtgaattcggagccatgaatcgtgataatgaagtcgatagagctagatgggctgaatattatattaagaaggctacttctattggtgttccatgcgttttatgggataatgcttactatgaaggaaaaggtgaacgttttggagctattaaccgtaccactttagaagtcgtatttccagattatattaatggattaatgaaaggattaggcaacaaggc

SEQ ID NO: 25145 - DNA, 577 bp, Piromyces finnis
  Glyco_hydro_catalytic_dom
ccgttttggtgttggtttcaatggtgctgctgtttccacctcaactacttcttccaaggttatgagagaacttgttaaataccaatttaattcattctcatacagtaaccttatgaaaccacttttcgttcttgaccaagctggttgtcaaaagaacttcaagaatggtagtaatgaaattgctcttaattttactccatttgttgatggtttagattatgctcaaaagaatggtcttcatattagaggtcacgttttagtctggcacaagcaattcccagactggttctttagagaagaatttgacgatgctaaggaatacgtttctgaagaagttatttacgaacgtttagaaaactatattaaacaatatctcggtttcgttaactacaactacccaggtgttgttgatgtttgggatgttgttaatgaagctgttgaagttttagaaggaaaattcgataacagtactggatggtacactcgtactattacttatgaaggtgatagaaacatctggtatgactttgttggtccagattatgttgttaaaactttccgtattgctcgtaaatac

SEQ ID NO: 25146 - DNA, 1062 bp, Piromyces finnis
  Glyco_hydro_catalytic_dom
ttatgtatacactgaagggacaaacttttatattgatggctacaaaatatatttttctggaacaaatacatactatttacatagttctcaaaatgaaagggtggatcttgcattagaagtatcagcaaaacataatattcaagtagttcgtgcatgggcattttgtgatcttaaggtgtgtggtgacaaacaatttgtgaaatttgaaaatggaaaggctgtatttcttgaagataatatggaagctatcgattactttatagcagcagcatcacaaagaaatatcagattagttttaggttttactaataattggactgattatggtggtatggatgaatgggttaaaggttatggtggtaaatatcatgatgatttctatactaatacagatatccgtaaggcattcaaaagctatattaaattgttaattactcgtattaatcgtcataccaatattcgttatagtgatgatcctacaatattttcttggcaattagctaatgagccaagatgcggaaatggtccttctggacttcctcaatcaggtaaatgcactcctgaggttataactgaatgggctaatgatattagttcatatattaaagaactagaccccaaccacttagtatcagtcgggtgtgaaggttttggtcttgaagctccagagggatctaaaggattatatgcatacaaatatgatgaaggtactgattttgaggctttaacagcacttccaaatattgattataatacttatcattattatcctattccatggggaatgaaagatttagtttctcatactaaagattggattgaatcacatcaagctgtaggaaaaaaattaaataaaccagtagtatttgaagaatggggtcttgaaattccaactgactgttcaaaagaagaacgtattcaatattacaaaacatggacaaagcaaatcctcgatgctgatgttccaatgaatatgttttggtatactgtcggtgaagattattatggaaccgataaatatattattaaagaagatgaattagtagctgccattgatccatt

SEQ ID NO: 25147 - DNA, 1050 bp, Piromyces finnis
  Glyco_hydro_catalytic_dom
ttttgttcaaactgatggtacaaattttgttgtcgatggttgtaaacgttacttttctggttcaaatacttattatttaatggtatcaaatcatgaaagagttgatttggctctcgaaacatatgctagacataaccttaatgttgttagagcatgggctttctgtgatgaatgtgaagatgcaacaagattagttgatttttctggtccagaagttacacttaacagtgaaaatatggaaaaggttgattattatcttgctgctgctgctcaaagaaacattcgtgttgttttaacccttactaataattggactgattatggtggtatggatgtttgggttaaacaattcggtggaaaatatcatgatgaattttacactaacagagatattgttaatggttacaaacaatatattaaggctatgattaatcgtgttaatacctatactggtcaatattataaggatgacccaactattttctcatggcaacttgccaatgaagcccgttgtaataatggtccacatggtcttccagtcaaaaattgtaatactgacactatcactaaatggatggatgaaattgcttctttcattcatgaagaagatccaaatcacttagtttcttctggtattgaaggtattggtcttactccaccagctggtgttgatccaaatacttatgtctactcatacattgaaggtactgattatgaagctattagtgctctcgactcaattgattacaatactgttcatatgtacccagttggttggggattaaaagattataccaaagatggtatgaaatggattcaagctcatgctgatgttgataagaaatttaataaaccaactgttgtagaagaatggggtcttagtacttctgctgataatgtaccacttgaagaacgtgatccaatttatactaaatggatggaaactgttttggaaaatgacaacattggtatgaatatgttttggtatgtttgtggagaagattattatggtactgatggttacttaatggaagaagacgagattactaa

SEQ ID NO: 25148 - DNA, 1032 bp, Piromyces finnis
  Glyco_hydro_catalytic_dom
aggttatctctcaaccaagggtaagtacatcgttgatgaaaagggccgtaaagttattttaggtggtctctcatggttcggtggtgaaactactaacctttctccacacggtttatgggctaactctttagaaaacttcattaagatcgttaaggatcacggttacaatcaccttcgttacccatggactaacgaaatgttattcccaggtgccgaaactcaatctgttgaccaagttaacaacccagatcttgctaacctcagtccattagaagttatggatgccgttattgatgcttgtggtaaggccggtttaaaggtttaccttgatcgtcacagaccactttctggtggacaaagtgaattatggtacattccagaagttccagaagaacaatggattgaagactggcaattccttgctaagcgttacaagggtaacccaaccgttattggtgctgatcttcacaacgaaccacacagttctgcctgctggggttgtggtgaaatcgaacgtgattggagacttgctgctgaaagatgtggtaacgctattcacgaagttaacccagactggcttattattgttgaaggtaatgatcactatggcgaagaaggttggcaaaaaggtgaatcctactggtggggtggtatgttaaagggagctaaggaattcccagttagattaaacgttccaaataagcttgtttactccgctcacgattatgataagaatgtccacatgcaagattggttcaaggaaccagacttcccagacaacatggaaccaatttgggatgacaaatggggataccttgttaaggaaaacactgctccagttcttattagtgaatttggttccctcttaagagatgctactgatattaaatggttaggtaacttagttagctacatgaaggaaaatgatgttcactggactttctggtgcttaaatccaaactctggtgatactgaaggtattcttggttacgattggaagactgttaacgcccaaaaggatggtcttctcga

SEQ ID NO: 25149 - DNA, 1050 bp, Piromyces finnis
  Glyco_hydro_catalytic_dom
tactttagctgctgcaagttcagctttagctttaacttcacaacaagttattggtgaaatgggtcttggttggaatttaggtaatactttagaagcatttggggattggatcaatggaagtacagttaatcaatttgaaactgcttggggaaatccagctgcaactgagcaattaattggagctattaaagataatggttttaacagtattcgtattccagttgcttggagtaatcttatgagttccgattacactattaattctaatttattaaaaagagtaaaagaagttgttagttgggttactaataaaaacatgtatgctatcataaatatccactatgacggtggttggttcgaacaattcggtacttctcaatctactcaagcaaatcaaaaatttaacaagatatggacacaagtttcaagttatttcaaagattttgatgaacatttaatttttgaatcattaaatgaagaaggttgttggaatgatgtttggaaccgttggagtaatgctggtgataagaataaggcatatggaactttaaacaatctcaatcaacaatttgttgatattgttcgtaactccggtggtaataataaaaatagacatttacttttagctggttattgtactgatattgatttaacagttgattctgcctttaagatcccatctgattcttctaatagattaatggtttctgtacactattacactccatctacttttactatccttgaaaaagatgaagattggggtaagtttgctggttcatggggtactgacgctgaagttaaagcccttattgctgatttcgataaacttaaaaaacgttttgttgacaatggaattccagttattattggtgaatacggtacagttttaactaacaaaaataaagacagtgttcacaaatatttattcacttgtgctcaatacgccactagtttaggaatgtgtccaatgctttgggataatggtgatcactttgaccgtaagggtcttaaatttaaggattctgaaataggtgacttctacaaaca

SEQ ID NO: 25150 - DNA, 1029 bp, Piromyces finnis
  Glyco_hydro_catalytic_dom
aattcgtgatatttcatctcttgaattaattaaggaaatgagattcggttggaatttaggtaatactttagaagcatttggggattggatcaatggaagtacagttaatcaatttgaaactgcttggggaaatccagctgcaactgagcaattaattggagctattaaagataatggttttaacagtattcgtattccagttgcttggagtaatcttatgagttccgattacactattaattctaatttattaaaaagagtaaaagaagttgttagttgggttactaataaaaacatgtatgctatcataaatatccactatgacggtggttggttcgaacaattcggtacttctcaatctactcaagcaaatcaaaaatttaacaagatatggacacaagtttcaagttatttcaaagattttgatgaacatttaatttttgaatcattaaatgaagaaggttgttggaatgatgtttggaaccgttggagtaatgctggtgataagaataaggcatatggaactttaaacaatctcaatcaacaatttgttgatattgttcgtaactccggtggtaataataaaaatagacatttacttttagctggttattgtactgatattgatttaacagttgattctgcctttaagatcccatctgattcttctaatagattaatggtttctgtacactattacactccatctacttttactatccttgaaaaagatgaagattggggtaagtttgctggttcatggggtactgacgctgaagttaaagcccttattgctgatttcgataaacttaaaaaacgttttgttgacaatggaattccagttattattggtgaatacggtacagttttaactaacaaaaataaagacagtgttcacaaatatttattcacttgtgctcaatacgccactagtttaggaatgtgtccaatgctttgggataatggtgatcactttgaccgtaagggtcttaaatttaaggattctgaaataggtgacttctacaaaca

SEQ ID NO: 25151 - DNA, 1044 bp, Piromyces finnis
  Glyco_hydro_catalytic_dom
aattcgtgatatttcatctcttgaattaattaaggaaatgagattcggttggaacttaggtaatactttagatgccgaatgtacctcatggatggattatgaaaagaacccaattggttctgaaacctgctggggtaacgtcaagactaatgaagatatcttcaagactttaatggacaaccaattcaatgttttccgtattccaactacttggactggtcacattggtgaagctccagaatacaagattaacgaacaatggatgaagagagttcacgaaattgttgattacccatacaagaacggtgcttttgttatcttaaacattcaccacgaaacatggaaccatgctttcgctgaaaccgttgatgaagctaaggttgaattagctcaagtttggaagcaaattgctgaagaattcaagggttacggtgaacgtttaatcttcgaaggtcaaaacgaaccaagaaagaacggtactccagttgaatggaacggtggtgataaggaaggttgggatgttgttaatgcaatgaacgctgtcttcttagaaaccgttcgtagttctggtggtaacaatgctaagcgtcatcttatgattccaccatacgctgctgcttgtaatgaaaactctttcaagaactttgacttcccagaagatgatgacaaggttattgcttctgttcacgcttactctccatacaactttgccttaaataatggtgaaggagctgttgataagtttgatgcttctggtaagaatgaactcgactggaatattaacttaatgaagaagagattcgttgaccaaggtattccaatgattttaggtgaatatggtgccatgaaccgtgataatgaagaagaacgtgctgcttgggccgaatactacatggaaaagattactgctttaggtgttccacaagtctggtgggataatggtgtattcgaaggtgaaggtgaacgtttcggtcttattgatcgtaaaaacttaaagattgtttacccaagtattgttgctgctttacaaaagggtagaggttt

SEQ ID NO: 25152 - DNA, 1044 bp, Piromyces finnis
  Glyco_hydro_catalytic_dom
aattcgtgatatttcttctattgaattaattaaggaaatgagattcggttggaacttaggtaatactttagatgccgaatgtacctcatggatggattatgaaaagaacccaattggttctgaaacctgctggggtaacgtcaagactaatgaagatatcttcaagactttaatggacaaccaattcaatgttttccgtattccaactacttggactggtcacattggtgaagctccagaatacaagattaacgaacaatggatgaagagagttcacgaaattgttgattacccatacaagaacggtgcttttgttatcttaaacattcaccacgaaacatggaaccatgctttcgctgaaaccgttgatgaagctaaggttgaattagctcaagtttggaagcaaattgctgaagaattcaagggttacggtgaacgtttaatcttcgaaggtcaaaacgaaccaagaaagaacggtactccagttgaatggaacggtggtgataaggaaggttgggatgttgttaatgcaatgaacgctgtcttcttagaaaccgttcgtagttctggtggtaacaatgctaagcgtcatcttatgattccaccatacgctgctgcttgtaatgaaaactctttcaagaactttgacttcccagaagatgatgacaaggttattgcttctgttcacgcttactctccatacaactttgccttaaataatggtgaaggagctgttgataagtttgatgcttctggtaagaatgaactcgactggaatattaacttaatgaagaagagattcgttgaccaaggtattccaatgattttaggtgaatatggtgccatgaaccgtgataatgaagaagaacgtgctgcttgggccgaatactacatggaaaagattactgctttaggtgttccacaagtctggtgggataatggtgtattcgaaggtgaaggtgaacgtttcggtcttattgatcgtaaaaacttaaagattgtttacccaagtattgttgctgctttacaaaagggtagaggttt

SEQ ID NO: 25153 - DNA, 1029 bp, Piromyces finnis
  Glyco_hydro_catalytic_dom
aattcgtgatatttcttctattgaattaattaaggaaatgagattcggttggaatttaggtaatactttagaagcatttggggattggatcaatggaagtacagttaatcaatttgaaactgcttggggaaatccagctgcaactgagcaattaattggagctattaaagataatggttttaacagtattcgtattccagttgcttggagtaatcttatgagttccgattacactattaattctaatttattaaaaagagtaaaagaagttgttagttgggttactaataaaaacatgtatgctatcataaatatccactatgacggtggttggttcgaacaattcggtacttctcaatctactcaagcaaatcaaaaatttaacaagatatggacacaagtttcaagttatttcaaagattttgatgaacatttaatttttgaatcattaaatgaagaaggttgttggaatgatgtttggaaccgttggagtaatgctggtgataagaataaggcatatggaactttaaacaatctcaatcaacaatttgttgatattgttcgtaactccggtggtaataataaaaatagacatttacttttagctggttattgtactgatattgatttaacagttgattctgcctttaagatcccatctgattcttctaatagattaatggtttctgtacactattacactccatctacttttactatccttgaaaaagatgaagattggggtaagtttgctggttcatggggtactgacgctgaagttaaagcccttattgctgatttcgataaacttaaaaaacgttttgttgacaatggaattccagttattattggtgaatacggtacagttttaactaacaaaaataaagacagtgttcacaaatatttattcacttgtgctcaatacgccactagtttaggaatgtgtccaatgctttgggataatggtgatcactttgaccgtaagggtcttaaatttaaggattctgaaataggtgacttctacaaaca

SEQ ID NO: 25154 - DNA, 666 bp, Piromyces finnis
  Glyco_hydro_catalytic_dom
agcacaaaccccaggtgccttagtttctgttgatttagctgatattttaccatattggccatataaatggccaggtatgcaaagctgggcaaacgaagttaaatcatttattgctgataaaaaaaagtctggtttaaccaattggtacggtttagaaatttggaatgaaccagatggtacatggaaagattctaatggtttaaactttaacgaattttggaaacaaacttaccaagtaattcgtcaaaatgatccaaatgaaaagattattggtccatgtgatagttggtacaatgaaagtagaatgcgttcattcttacaattctgtaaaactaataatgttattccagatattatgtgttggcatgaattaagtggtattgaaaatgtttcaaaccacattaaggcttaccgtgaattagaaaaatctcttggtatcaaggaacttccaattagtattaatgaatattgtgatgctgaacacgaattagaaggtcaaccaggttctagtgcacgtttcattggtaaatttgaacgttataagattgacagtgctatgatttcatggtggtttgtaccaaaaccaggtcgtttaggtagtttattagctactgatactcaaaagggtgctggttggtatttctacaaatggtacggtgatatgac

SEQ ID NO: 25155 - DNA, 615 bp, Piromyces finnis
  Glyco_hydro_catalytic_dom
accaggttggccttataaattcccaggtcttcaaacttggttaaatgaagttaagtcctttgttaatgataagaaagcttctggtttaaaaaattggtatggtctagaaatttggaatgaaccagatggtacatggaaagattctactaacggtttaagttttaatgacctttggaaagaaacttacaagcttcttcgtcaactcgatccaaatgaaaaaattattggtccatgtaatagtttttaccatgaagatagaatacgttctttcttacaatttgcaaaacaaaataattgtttacccgatataatgtgttggcatgaattaagtggtattgattacgtatctagccatttcagagcttatcgtaatatggaaaaatctcttggaattaaggaacttcctattactatcaatgaatattgtgatgctgaacacgaattagaaggtcaaccaggttcaagtgctcgttttattggtaaatttgaacgttacaagattgatagtggtttaatcacttggtggtttactgctcatcctggtcgtttaggtagtttattagctactgatactcaaaagggtgctggttggtatttctacaaatggtacggtga

SEQ ID NO: 25156 - DNA, 528 bp, Piromyces finnis
  Glyco_hydro_catalytic_dom
accaggttggccttataaattcccaggtcttcaaacttggttaaatgaagttaagtcctttgttaatgataagaaagcttctggtttaaaaaattggtatggtctagaaatttggaatgaaccagatggtacatggaaagattctactaacggtttaagttttaatgacctttggaaagaaacttacaagcttcttcgtcaactcgatccaaatgaaaaaattattggtccatgtaatagtttttaccatgaagatagaatacgttctttcttacaatttgcaaaacaaaataattgtttacccgatataatgtgttggcatgaattaagtggtattgattacgtatctagccatttcagagcttatcgtaatatggaaaaatctcttggaattaaggaacttcctattactatcaatgaatattgtgatgctgaacacgaattagaaggtcaaccaggttcaagtgctcgttttattggtaaatttgaacgttacaagattgatagtggtttaatcacttggtggtt

SEQ ID NO: 25157 - DNA, 129 bp, Piromyces finnis
  Glyco_hydro_catalytic_dom
tgtttggggtgttggtgatccagatagttggttaggtcaagacaaaagaggtttacttttcgatggtagttacaagccaaaggctcaatataacgctcttttaaatgttttaaaatcaactaaagctgc

SEQ ID NO: 25158 - DNA, 417 bp, Piromyces finnis
  Glyco_hydro_catalytic_dom
ttattgtactgatattgatctaactattgatgaagcttatgttgttccaaaagatgatcgtgttatggtttctgttcattattataccccttctaccttcactattcttgaagaagatgctgattggggtaaagcccaaccaacttggggatcagaaagtgaagttgaatatcttcttaacgatttcaaaaaaataaaaacacgttttgtcgataatggtattccagtagttattggtgaatatggtactgttaccaaaaataaggatattaatagtgttcataaattcttaaaaactgttgctgaaacttcacttaattctggtatgtgtccattcttatgggataatggtgaacattttaaccgcaaaacattagtctttagagatgaagctatcggtgaaatctacaaggtact

SEQ ID NO: 25159 - DNA, 828 bp, Piromyces finnis
  Glyco_hydro_catalytic_dom
tgcttggagtaatcttatgttggataattatattatcaatccattattactttctagggttaaagaagttgttgattatattgttaataatgatatgtacgctattgttaacattcattgggatatgggatggtttacaaaattcgctactaatgaaaaagaagctttcaaaaaatatacaagtatttggggtcaaatatctcaatattttaaagattatgatgaacatttggttttcgaatctttaaatgaagaaggttgttgggatgaaatatggaatcaatggagtaatcaaggggataagaaaaaggcttttaaccttttgaataatattaaccaagaatttgttgatattttccgtaattctagcgaaaataatgcgaaaagacacttacttttagctggttattgcactagtcttgatttaactagtgatgaattatatgttattccaaaagatgatagagtaatgatttctgttcattactacggtccatctacatttaccattcttgaagaagatgctgattggggaaaagctgcatactcttggggtacagaaaaagaaattaattaccttgttgatgaacttaaaaaaataaaaaagaactttattgataaaggtattccaataattgttggtgaatatggtactgctataactaataaggaaccagctagtgttattagatggttgaaaactgttgctaaaactacttcctcctttggtatggttccatgtctttgggatgctggacaatactttgatcgtgaaaaattagttttcaagaatcctgcaattggcgaattatttaaacaactttctag

SEQ ID NO: 25160 - DNA, 102 bp, Piromyces finnis
  Glyco_hydro_catalytic_dom
tggatacaaagctaaatttgttcttgaaaatggctttgctggtatgatggtttgggaattagaaaatgatactgatgatttcgaaatattgactggttatag

SEQ ID NO: 25161 - DNA, 99 bp, Piromyces finnis
  Glyco_hydro_catalytic_dom
tggatacaaagctaaatttgttcttgaaaatggctttgctggtatgatggtttgggaattagaaaatgatactgatgatttcgaaatattgactggtta

SEQ ID NO: 25162 - DNA, 138 bp, Piromyces finnis
  Glyco_hydro_catalytic_dom
tggatacaaagctaaatttgttcttgaaaatggctttgctggtatgatggtttgggaattagaaaatgatactgatgatttcgaaatattgactgctataaataaccaattaggttgtgatggttcttctattaatga

SEQ ID NO: 25163 - DNA, 687 bp, Piromyces finnis
  Glyco_hydro_catalytic_dom
ttttagtgaatggagatattcaagttacccagttagccgtatagacttttcaaaatttacccatcttaactatgcttttgctgtcattgacccaaatacatatgcattaactggttatgaaggttggattttaaatgaagtagttacagctgctcataatcaagatgtaaaagttcttatgtcagttggtggttggtatggaagtcgttattttactaaaatgacatcttctgaaaataatatgaaaaaatttgctgaaagttgtaaaaatcttattgatacctatcacattgatggtatcgatattgattgggaatatccaggaagagaaggtgcttgcaataacccggattatgccaatgataccgataattatttaaaacttttaaaaatattacgtgaatatattggtaatgaaaatataatttctgcagctgtcagtattactccatttgaaaaaaatggtcagccaataacaaatcttgctccatatgctgaatattttgattttattaacattatgggctatgacttcgcaggtagttggtcgtctgttacttctcatcatgctgctttatatgacccagaagctggtgatatattgtctatttcctcaggagttaataattggttaaatggtcaatttcctgcagacaaaattgttattggtgttccaacttatggaaa

SEQ ID NO: 25164 - DNA, 933 bp, Piromyces finnis
  Glyco_hydro_catalytic_dom
aaaacttcaatatttgggtgtgaatgaatccagtggtgaatttggtgaaggtaatttaccaggtgtttacaataaacattatatttatccagatgttaaagccatcgaaactactatcgaacaaggtatgaacgctttccgtatttgtaacagatgggaacgtttacagcatgaattatttggtgaatttaatgaattcgatatcactgaatttaaaaaggttgttgatgctactactgctaagggtgccattgctattattgatccacataactatgctcgttacaacaataaacttattggttctgaagatgttccaattgaagctttcgttgacttctggactagacttgctgaaattttcaaagataatgaaaatgtttggttcggtttagttaatgaaccacacgatatggaaactgatgattggttcaaggcagctcgtgctgctgttgatggtattcgttccactggtgctaagaacaacattttaattccaggtaacggttggactggagcttggagttggggtaaggaagcttggtatggtgaagctaatgctgatgttgccttaagatatttctcatctgaagatgaaaatattctttttgaagttcaccaatactttgataaagattactctggtacaggtgatcaatgtgttcaacgcccatgtcaaaatctctttaaagaatttgttgaatggcttaagaccaacaatttaaagggatggattggagaaattggttcataccttactgatgaatgccgtgaatgtgttcaagaatccattgaatatctccaagaaaacaatgaatatgttcttggtactttatggtgggcagcaggtccatggtggggacataatgctatgtctattgaaccaaatgccgaaaaagcattcccaggacaaatggcatggttaaagccata

SEQ ID NO: 25165 - DNA, 933 bp, Piromyces finnis; identical to SEQ ID NO: 25164
  Glyco_hydro_catalytic_dom

SEQ ID NO: 25166 - DNA, 957 bp, Piromyces finnis
  Glyco_hydro_catalytic_dom
tcaacaagttagaccagatttttactatggtgttgccactacaaagtcattcttttctaacccaaaatacaaagatatcatttctacttacaacttacatactggtggtaatgaatgtaaattctacactattcaaggtactcaaactttcaatactaaacaatgtgatgattcaattgcttttgctaagaaattcggtgctaaattccgtggacataatcttttctggccagccaactctccagattggttcaaaaattacagtgatgatattgaagaagttaaagcttattatcttgactatgttgccaaggttttagaccattacaaagatgaagaagatatcatctactgggatgttgttaatgaatccgtcactgatgattctactatcgataagtataagttacgttatggttctgatagaagtaatgaattcaagggttgggatacttacactgaagatattttcactcttgctcgtgaacatactaatccaaatgttaaattaatttacaatgattataatgctgaaaacaacaacggtaacttcaatggtaaaactggtgctgtttacaagtatattaaggaaatgaaagaaaagggtattccaattgatggtgtaggtttacaaatgcacatttcttgtaactacactccaaactacgaacaactcactgaattaattgatatgtacaaagaaatcggtgttgaagttcatgttactgaaattgatgtcagtatgaagaattgtaaaactcatgaccaacaaagaaaattatatatggatgttttcagagcttgttttgataatgaaaactgtaaggtttttactgtttggggtgcttatgatactgaatcatggattggtgcttcaaacgttccattaccatttgatgatgatatgtatccaaaggatatctactttgatatgttagaatatgttatgaaacaatt

SEQ ID NO: 25167 - DNA, 945 bp, Piromyces finnis
  Glyco_hydro_catalytic_dom
ctatgctaaagactttagaattggtgttgctgctaacacaatgagattcaataatcaagcttacaatgaagccttaaaggctttcaactacatggttgctgaaaatggttgtaagttatctggtattcaacaaagacaaggtaactacgattttagtgattgtgataatcactataagaaggctaaggaattaggtatggctttccgtggtcatgctcttatctggcacgcatacatgccatcttggtttgaaaatgctaatgcttcaaccttaaagaatgccattgttgaacatgttaccaaggttcttcaacactacgaaggtaaaattgatacttgggatgttgtcaatgaagctattgatgacagttcaaatggtaacggttggaagatgcgtaactccttcctttatcaaaaggttccaaactttgttgatcttgcttttgaaactgcccgtaaggtttctccaaatactaagctcttctacaacgattacaatactgaaggtatttacggaaaaactgaatccgttttccaattcgttaaggacatgaaatctcgtggtattccaattgatggtgttggtattcaatatcacgtttctgttgacagtcaaccacaatacaacaagattgatgatttaatttctcgttactgtggtcttggtcttgaagttcacattactgaacttgatgttaagtgtggtagccaatgttcttcatctaatgttgaatccaagcaagctactgtctttactaatgctttaaaggcttgtcttaacaattcttgttgtactggttatcttgtttggggtgttggtgatagcgatagttggttaggtgctaacgaaaagggtttacttttcaacagtaactaccaaccaaaatctcaatacacagctgttcttaatgtcttaaaggaaaccaagccaaaggctactaccac

SEQ ID NO: 25168 - DNA, 945 bp, Piromyces finnis; identical to SEQ ID NO: 25167
  Glyco_hydro_catalytic_dom

SEQ ID NO: 25169 - DNA, 222 bp, Piromyces finnis
  Glyco_hydro_catalytic_dom
tgttgaatccaagcaagctactgtctttactaatgctttaaaggcttgtcttaacaattcttgttgtactggttatcttgtttggggtgttggtgatagcgatagttggttaggtgctaacgaaaagggtttacttttcaacagtaactaccaaccaaaatctcaatacacagctgttcttaatgtcttaaaggaaaccaagccaaaggctactaccactac

SEQ ID NO: 25170 - DNA, 222 bp, Piromyces finnis; identical to SEQ ID NO: 25169
  Glyco_hydro_catalytic_dom

SEQ ID NO: 25171 - DNA, 219 bp, Piromyces finnis
  Glyco_hydro_catalytic_dom
tgttgaatccaagcaagctactgtctttactaatgctttaaaggcttgtcttaacaattcttgttgtactggttatcttgtttggggtgttggtgatagcgatagttggttaggtgctaacgaaaagggtttacttttcaacagtaactaccaaccaaaatctcaatacacagctgttcttaatgtcttaaaggaaaccaagccaaaggctactaccac

SEQ ID NO: 25172 - DNA, 924 bp, Piromyces finnis; identical to SEQ ID NO: 25143
  Glyco_hydro_catalytic_dom

SEQ ID NO: 25173 - DNA, 864 bp, Neocallimastix californiae; identical to SEQ ID NO: 23282
  Glyco_hydro-type_carb-bd_sub

SEQ ID NO: 25174 - DNA, 783 bp, Neocallimastix californiae
  Glyco_hydro-type_carb-bd_sub
gacacaaaacaataactcatatattttaaaaaataactatgctaccgtggttatttctaaaaaagatggttatattacttcattaaagattgctggtgacaatcaagaatttttaaatagagcttatattgatgctaatggttcaaaagctggctttcatgcaaaaaaaagtacaattattaagaataccaatgatcatgttgaaattgcattcactgataatgtattaaatatggattgggaagttagatatactatgcttaatgatactaagggtgtttacttctcattaaaacttgaccataaagcaagctatgctgatacacaattcagtgaaatacgtttagtttttagattaaagagtaatccattcaattggttacaaattgaagataatgttggtcgttacttaccaactgctgaagaacaaaagaattgtgaagtaatgggtccaaaggaagcttgtaaggttaaaactggtgaagttcttcacaagtacgattggtctattgatgctttaaaacatgatgttcatggtttctctactaaaaatggtttaggttgttggtttgtccttccatctatggaatggaagaatggtggtgcctacaatcgtgatcttgcctgtcacaatggtgaaaatgattccatacaaattatgtacatggctggttctcactatggtgctggtgatgaatacccaaagaagggtgaaaattggtcaaaggtttacggtccatatttaatttatgtaaataaagctggttctccacaagcctcatg

SEQ ID NO: 25175 - DNA, 870 bp, Neocallimastix californiae; identical to SEQ ID NO: 23284
  Glyco_hydro-type_carb-bd_sub

SEQ ID NO: 25176 - DNA, 678 bp, Anaeromyces robustus
  Glyco_hydro-type_carb-bd_sub
aactgaaaacaatacttcctatatattatcaaatggattagcaacttttacaattgctaaaagttctggttttattacttctatgaagtataaaaacaattctcaagaattcttaaacagatcttatattgatgctaatggaggaaaagtttatttctctgttactagttcttcagtagttataagaactgatgatttagttgaaattgtattttatgatgactattccaagcatgtaggcactggttttgctattgattgggaagtcagatatactatgagatctggtgtttccggtctttatttctctttaacacaagctcataaatctaattacgaagaagctcaatgttctgaattaagacttgttatgcgtttaaagagtgatgttttcaattggttacaagttgatgatttcactaagagagttatgccaactgctgctcaacaaaacaaatgtactactctttctccacaagaagcttgtcaattagaaacaggagaagttattcataaatatgattggtctattgatgttcttgaacataaggttcatggttttgccagtatcagtaaaaatcttggttcttggtttgttatgccaagtatggaatggaaaaatggtggtgccgttaacagagatcttgcttgtcaccaaggtggtgctgattctcttca

SEQ ID NO: 25177 - DNA, 867 bp, Piromyces finnis
  Glyco_hydro-type_carb-bd_sub
ttccattagtgttactgaaaatcaaaattcatacattttatcaggcaagaattttgaattcctcatcaataaatcatcaggtcttctcagtacctataaatacagaggtgaaaccatcatcactgaaggtccaactcctaacttctggcgtggttatgttgagaatgataataatggtgctggttgggcaaaaacttttgattccaactggcgtaatgctatgaatggtgctcgttgtgataaaatcgaggttaacaatggaagtgatagtagtgaaaaaatcattgtttcacatcttacccttcctaaagttggaagtacaaaggtagacataacctacaccgttcattgtgacggaagtgttgatgttgaattcaatgttgatgctactagatcagatcttggaaacttccttcgtgttggttcaatgatgaaattaccagaaggctttgaaaagcttagttggtatggtaatggtcctgttgaaactttcaatgatcgtaaaacaaatggtagaatgggagtatgggaaagtaccgtaacagatatgttctatccttatatgaaggcagacgattgtggaaatcttacagaccttaagtggatttcagttcaaagtaaaaagagaagtgcaagtatacttgttgtcgctgaaggagcagtagaaggaagtgctcttcattttgctccagaagatcttatgcgtgcagatcatccatataaacttagaccacttaagacgactattctcagtgttgattatggatctatgggtactggaagtgctacttgtggacaagctacacttgataagtatcgtcttccttccgatagaccatataattggaaattcactattatccctgt

SEQ ID NO: 25178 - DNA, 687 bp, Piromyces finnis
  Glyco_hydro-type_carb-bd_sub
aactgaaaataatacttcatacattttatccaatggattagcaacatttacaattgctaaaagttcaggttttattacttcaatgaagtataaaaacaactcacaagaatttttaaatagatcttacattgatgctaacggaggaaaagtttatttttctgtaacaagttcatatgtagccactaaaaatagtgatttagttgaaattgtttttgttgatgattattccaaacatgttggtactggatttgctattgattgggaagttagatatactatgaaatcaaatgtttctggtatctatttctctttaactcaatcacacaaatctaattatgaagaagcacaatgttctgaattaagactagttatgcgtttaaagagtgacgtatttaattggttacaagttgatgactttaataaaagagttatgccaactgcttctgaacaatcaaaatgtgttactctttcaccaagtgaggcgtgtagattagaatcaggagaagtaattcataaatatgattggtctgttgatgctcttgaacacaaggtccatggttttggtagtattagtaagaatctcggttcatggtatgttattccaagtatggaatggaaaaatggtggtgctgttaatagagatcttgcgtgccatcaaggtggttctgattcacttcaaattttata

SEQ ID NO: 25179 - DNA, 702 bp, Piromyces finnis
  Glyco_hydro-type_carb-bd_sub
tcttactgataatggaagttcatacatattaagaaatgattatgccattgttacaattgcaaagaattccggttatattacttccttaaaattaaatggaaataatcaagaatttttaaatagatcttatattgatgctaacggtggaaaagtttatttttcaccacaaagtagcaaagtaataaaaaatacatcctcacatgtagaagttgctttctatgataattataattctaattcaaaattaggacttgattgggaagttagatacactatgctctctgatacaagaggtgtttactattcattaactaatactcacaaaacaaattacccagaaacatcatatagtgaaattcgtttagtactcagattaaaggcagatattttcaatcacttacaagttgaagatgatgtataccgtgatatgccaagcgctgctgatcaaaacaaatgtgttgaaatgggaccaaaagaagcttgccaattaccaaacggagaagttattcacaaatatgattggtctgttgatatgttaaaacatcatattcatggtttctccagtaaatcaactggtttaggttgttggtttgttattccatcattagaatggaagaatggtggtgcatacaaccgtgatctttcttgtcaccaaggtggtagtgattcattacaaattatgtacatgaatggttcccacta

SEQ ID NO: 25180 - DNA, 654 bp, Neocallimastix californiae
  Glycoside hydrolase/deacetylase
ttgggctggcttccgtaaaggtgcagcttcatttacttttgatgatggtgctccaagtcacgtaagcgatggtgccccagtatttgaaaagtatggctatagagctactttctttttggtatacaactggaatccaaactggagtggtttccaatccttggccaacaagggtcacgaaattggtagtcacagtaatagccacggtcaaaacatgagtggtgaagaagcttcttccaagagaaatattggaggaaaaattaatcaaaagtacggcattatttcagtcgcctatccaaactgtaacgttccaaacgaaggtgccgttttacaaaattacattttaggtcgtatctgtaacggtagttggcaaggtatgtccgataatatgggaaagaatggtccatctaactgggctaaggtcccagctattatgactggttctgaaggtcaaattagaagcacaaacgattttacttctcaaatgcaaaaggttattcaaagtaacggatgggtttccttccttactcacggttaccaaggtaagaacaatggttctgccacctactcaccaactgatcttagtgctattgaaggagctcttcaatgggctaaacaaaacgacaagaacatttggattgctccaatgggtttcgt

SEQ ID NO: 25181 - DNA, 636 bp, Neocallimastix californiae
  Glycoside hydrolase/deacetylase
ttcatttacttttgatgatggtgctccaagtcaagtcagcgattgtggtccagtattcgacaagtacggctacaaaggtactttcaacttggtttacaactggaaccccaactggagcggtttccaaagtttggccgacagcggtcacgaaattgctagtcacagtaacagtcacggaaataatatgagtggtgaagaagcctcatcaaagactaatattggaggtaaaattaagcaaaagtatggtattattactgttgcttatccaaactgtaacgttccaaatgaaagagctgttttacaaaactatattgtaggtcgtatttgtaatggtagctggcaaggcatgtctgatattatgggtaagaatggtccatccaactgggcaaagaccccagccattatgactggtgctgaaggtcaaattaaaagcactaatgactttactggtcaaatgcaaaaggctgtccaaagtaacggatgggttgctttccttactcacggtttccaaggtaagaacaatggtccagctacatattctccaactgaccttaacgctatcgatggtgctcttaaatgggctaaacaaaacgacaaggatatttgggtcgccccaatgggtttcgttgctatgta

SEQ ID NO: 25182 - DNA, 636 bp, Anaeromyces robustus; identical to SEQ ID NO: 25181
  Glycoside hydrolase/deacetylase

SEQ ID NO: 25183 - DNA, 519 bp, Anaeromyces robustus
  Glycoside hydrolase/deacetylase
attctacactcaatgtaataatccaaaacattgggctatgacttatgatgatggaccaaccgaatttgctgatgcaattttagatcttttaaaggaaaaaggtattaaagcaacattcttcattgttggacatatgtatatggataataatagttctgattggtctagaattattaagagaatggatagtgaaggtcatattgttggtaaccatacttatgatcaccaagatttaactggactttcatcagatcaaattattagtcaaatgaaacaagttgaagatcgtatcttcaaaattattggtaagagaccagcatttatgcgtccaccatatggttcaggtaatggtaaccaaaatgttatgaatgcacttcaacaagctggttacacagctgctattaattggaatgttgatccacaagattacagtaatggtggtgatgctaattatgctagacaagttattaatcaagctaaaggtcaaccaatcattaccttaaatcacttaaaatacaa

SEQ ID NO: 25184 - DNA, 891 bp, Neocallimastix californiae
  GLYCOSYL HYDROLASE 43 FAMILY MEMBER
cccaatcatcactcaaaagtatagtgctgatccaggtgttatggtttacaacggtagagtttatgtttatgctactaatgatggtgatgctggtaccagatacaattcagaaaacacttacggacaaattaacactattaatgttatgtcttctgctgatttagttaactggatggatcacggttcaattccagctgctggtggtggtggtgctgctagatgggcatctaactcatgggctccatgtgctgcttggaaaaagattaatggtaaggataagttcttcctttactttgccaataacgctagtggtattggtgttttaactgccgattctccaactggtccattcaaggatccaattggtagagctcttatctcacgtcaaactccaaatagtaatgttgaatggcttttcgatccagctgttatcgttgatactgatggtactggttatctttactacggtggtggtgttccacaaggtcaaaatgctaatccaagaactattcgtgttgccaagttaggaaatgatatgacaagtattcaaggtactccacaaatgattgatgctccatgggtatttgaagattctggtattaataagattggtaacacttatgtttactcatactgtactaactgggctggaggtccatacggtaatgccagaattgcttacatgactagtaacaacccaatgagtggattcaaataccaaggtacttgtttcaacaatccaggagatttcttccaaactactggtaacaaccaccacactattattgaattcaagaataagtactacatcttctaccacgctgaatggcttaacaagcaaattttaggtggtcaaaagggttaccgtactactcatgttgatgaattacc

SEQ ID NO: 25185 - DNA, 1653 bp, Neocallimastix californiae
  GLYCOSYL HYDROLASE 43 FAMILY MEMBER
ggtagcaacagcagctactactgtaaataatccaattatatgggctgatgtacctgatccagatattattagagtagatgatacatattatatggttagtactactatgtacttcactccaggtgctccaattatgaaatcaaaggatcttgtatcatgggaaattgttacttacacctatgatattttagccaatggtgatgttcaaactctttctagaggtcaacatgattattctcatggttcatgggctgcaagtttacgttataataaaggaattttctatgtattctttggtagttatggtacaaataaatcttatatatttaaaactaaggatattgaaagtggaaaatgggaacgttttgaaattaacggaatgtaccatgatgcttccattcttttcgatgatgatggtagaaattacctcgtttatggaggtggtggtgaaattaagattaaggaatttaatgcggaaatgaccaattttaaatggggaggtcttgataaaactttatttagaactaatctttctggtctcgctggtgaaggatctcatgttatgaaaattaatggatattactatgtatttattattgcttggccaagtggtaaaggtcgtattgaaatttgttaccgtagtaaagacctcactggttactatgaaaacaaaacagttttagattcaggattaggttcctatggtagtggtgttgcccaaggtggtattgtagatacccctgatggtaaaaaatggtttggattattattccaagatcatggtgctgtcggtagaattccagttcttgttccagttaattggcaaaatggatggccaatgatgggtgttaacggtaaagctccacttactttacaaattgatggaggattcaaaggaagcaaacttgctaaaagtgatgactttaattacgacagtaatcatttagatttagtatggcaatggaatcacaatccagataattctgcttggtctgttactgaacgtccaggttggttacgtcttaaaaataaacatgttgcttctgaaatacttaaagctagaaatactcttaccatgcgtacggagggtccagcatgtagcagtgttgttaagttagatgtaactaatttaaaggttggtgattacgctggtctttctgcttttcaatataattacggtaatgttggtgtttatgttgctgataacggtgaaaaacgtatatacatggctagtaacggtaataccaatggagatgtcatcaaggatagtagaaacaatattgttcaagaaacaaaattaaatggtaatgaagtctaccttaaattagatttccgttttagtaatgttgaacgtgatggaagtgcttcatggaatattgataaggtaaacttttattattcttacgatggtagtaaatggactaaaattggtaaggaaattggtatgacctatgatcttaaactcttcaccggttacagaagtggtctttttagttacccaactaaaaatactggtggttatgctgactttgacttctttaaatatgaacgtgaaaagtggaatcaaggtactattgctagtgacgacgatactaagaccgtttatcctggtaatcaagaaagtaatcaaggtaataataatgatcaaaacca

SEQ ID NO: 25186 - DNA, 1788 bp, Neocallimastix californiae
  GLYCOSYL HYDROLASE 43 FAMILY MEMBER
tccaattaatactattaagtacagtgctgatccaggtgtcatggtttatgatggtagagtttatgtttatggtaccaatgatggttatgctggagaattaggaagaaacccacaggataatacttatggtcaaattaatactattaatgttatgtcttctgatgatttagttaattggatcgatcatggtactatcccagctgctggtagaaatggtgctgctaagtgggccggtaactcatgggcaccatgtgctacacacaagaaaatcaacggtaaggaaaagttcttcctttactttgcaaacagtggtaatggtattggtgttttaactagtgattctccaactggtccatttgttgatccaattggtcatgctcttatttctcgtagtactccaaattgttccaatattgtttggttattcgatccagctgtatttgttgatgatgatggtactggttatctttacttcggtggtggtgttccagataatcaatcttctaatccaaagactgttcgtgctgttaagttaggtaatgatatgactagtcttgctggtaatccagttactattgatgctccatgggtatttgaagattctggtattaacaaatccggtgatacttacttctactcatattgtactaactggaatggtggtccatacggtaatgctaagattgcttacatgactagtaagaatccattaggtccatttactatgcaaggaactgttttaaataacccaggtgatttctttggaactactggtaacaaccatcacactatcattgaatttaaggaccaatggtacatcttctatcacgctgaatggcttaacaaacaagaatttggaagtcaaaagggataccgtacttcacatgttgatgttttaccattttctaatggtaaatttggaaatgctaagggtacattaactggtgtaactcaattatttaaggttaatgcttacaatactaactatgcttcaatgatggcatggcaaggtggtgtttctacaaatggtttaggtcatactactgttacctacaacagaggtgaatggactggtgtttctaatgttgattttggagaagctgctacctccgttaagataacagccgcttctaacaatggtgctgttattagaattactactggaagtccaaatggtgatgttgttggttatgtttctattccagctactggtggtaactccaactttaagactgttactgctgatattaacactgttagtggaactaagcacgttttctttgttgcttctggtgatgttgttgtcgatacctggcaattcattggatccggtactggatcagatgaaccaattgaatttggtgatggtgaacttgatcttaatgacaaggctaaacttgaagatggttggtattacattaagaatccaagcactggaaagtacattcaagttgaagatggtgttggtcgtaatagtgctaatgttgttattggttctgaacgtaaggatgatgcccaaaagtggaaggttactaacactaatggttatgttacctttacatctgctcttggtaattatatgattgatattgccaatggagaagatagaaacggagccaatgttcaaatttatgatgcctacggtggtgatgctcaacaattcattatctacaagactggtagagaaaatgtttacactattggtactaaggcttctgcaggagataaggctattgatattgaaggagcacgtaatggtgaaaacgttaatctcttacaatggactaa

SEQ ID NO: 25187 - DNA, 891 bp, Neocallimastix californiae
  GLYCOSYL HYDROLASE 43 FAMILY MEMBER
cccaactattactcatagatatagtgctgatcctggtgttatggtttacaatggtagagtttatgtatatgccaccaatgatggtgatgccgctactagatataattcagaaaacacttacgctcaaattaataccattaatgttatgtcatcagctgatttagttaattggatggatcatggttcaattaatgctactggtggtggtggtgctgctaaatgggctaaaaactcttgggccccagctgccgcctggaagaaaattaatggtaaggataagttcttcctttactttgctgataatgctagtggtattggtgttttaactgctgattctccaactggtccattcagggatccaattggtagagctcttatttctcgtcaaactccaaacagtaacgttgaatggcttttcgatccagctgttttcgttgatagtgatggtactggttatctttactatggtggtggtgttccaaaaggtagagaagctaacccaaataccattcgtgttgctaaattaggtggtgatatgactagtatttctggtactccagctaatattgatgctccatgggtatttgaagattctggtattaataagattggtaacacttatgtttactcctactgtactaactggaatggtggtccatacggtaatgctagaattgcttacatgaccagtaacaatccaatgggaaaattcactttccaaggtacctgtttcaacaatccaggtgatttcttccaaactactggtaataatcaccacaccattattgaatttaagaacaaatactacatcttctaccatgctgaatggcttaacaaacaaatcttaggtggtcaaaagggttaccgtactactcatgttgatgaattacc

SEQ ID NO: 25188 - DNA, 1113 bp, Neocallimastix californiae
  GLYCOSYL HYDROLASE 43 FAMILY MEMBER
tcatgatccatctatcgttaaaagtggtaacaaatattatatttttggatctcacatggacgctgcatatactaccgatttatggaaatttacaaaattgtatacaggtgttgatgaaaataataaaatgtttacaaatttattctcaaaatccaactatgatgcatttaaatttgtaggaaagaatagtgatggaggttattctgtatgggcagcagatgttatgtataataagaaaatgaaaaaatgggttcaatatttctgtacttcttctacttatattaaatcaagtctttgttatggtatagctgataaggttgaaggaccatatacttataaaagttgttttctccattcaggtatggattcaggatctgttggcaaaactaatttaagggctattacaggaactgaagataaaaatcgttattatccaaataacagatataacaacaaagtttatccaaatgctattgatccaaatgcattctatgattttaatggtagactatggcttgcttatggttcttggtcaggtggtatttacattttagaattagatgaaagcactggtcttccaaagcataatatttcaaatggtaataatgttgataaatattacggtaagaaacttgcaggtggaggtcatcaatctattgaaggtccatacattttaccatacaaagctgctggatactattatttgtttgtatcatatggtactcttacttcaaatggtggttaccaaattcgtttgttccgttcaaagaatccagatggtccatatactgatgttgctggtaaagaatttatgagtggtactaattcaaactttggtgttaagattatgggtaattatggtattccaggaagagaaaaggcttatatggcaccaggtcacaactctgtattaattgacgatgatggtaaaattttactttgctaccatactcgttttaatgatggtcaagaataccacgaaccacgtgttcaccaaatgttccttaataaggaaggttggttaaccgctgctccatatgcttacactggagaaacaatttccaagactggttatagtatgaatgatatggttggatcttataaattcttatt

SEQ ID NO: 25189 - DNA, 873 bp, Neocallimastix californiae
  GLYCOSYL HYDROLASE 43 FAMILY MEMBER
tccaattattaaggatatgtacactgctgatccagctccaatggtttatggtgataccctttacctttacactactcatgatgaagatgtacttaagaacaacttctacactatggaaaactggtatgtcttctctactaaggatatggttaactggactaaccatggtcaaatcttatctttagatgatattgaatgggctgatgaaagagcttgggctccacaaactgttgaaaaggacggaaagttctacttctacttcccagctcacaagattgatggtggtatggctattggtgttgctgttgctgattctccaattggtccattcaaagaaattggacatccaattgtttatgaagatgactggaatgattttgacccaactgttttcattgatgatgatggtaaggcttacttatatttcggtaatccagaacttagatatgttgtcttaaacgacgatatgatttcttatgatgaagaaattggtgttgttaaggttccaatgactgaagaatccttcggtaagggtggtcacgataccggtacatcctatgctgaaggtccatacttctacaagagaaacggtctttactacatggtctatgctgccttcagagaaggttctcacactgaatctcttgcttattctacttctgaaaagccaactggtccatggaagtatggtggtgttcttatgactgaaggtactgctttcactaatcatccaggtattgctgatttcaatggtaaatcttacttcttctaccatactgatgaacttccaggaggtggtgacttccacagaagtgtttgtgttaccgaatttgaatacaaggaagatggatctattgaaactattccaatgtg

SEQ ID NO: 25190 - DNA, 951 bp, Neocallimastix californiae
  GLYCOSYL HYDROLASE 43 FAMILY MEMBER
tccattgtttactcatagatatagtgctgacccaggtgttatggtttataataatagagtttatgtctatgctactaatgatggtgatgttgccactaaatttacagacgataatacctatagtcatattaattcacttaatgtcatgtcttctgaagatttagttaattggacagatcatggttcaatcttagttgctggtaataatggtgctgctaaatgggctggtaattcatgggctccatgtgctacttataaaaaaattaatggaaaggataagttcttcctttactttgctaataatgctaatggaattggtgttttaactagtgattctcctactggtcctttcaaagatccaattggtaaagctcttatcactcgtcaaactccaaattgtggtgatgtcgcttggctttttgacccagctgttttagttgatactgatggtactggttacctttacttcggtggtggtgtaccagacggtaaggatgctgcaccaaaaactattagagttgttaaattaggagccgatatggtaagtcttgccggaactccacaacttattgatactccatatgtatttgaagattctggtataaataaaattggaaatacctattactattcttactgtaccaattggtctgcaggtgaaccttatggacaagctagaattgtttatatgaccagtagtaatccaatgggtccattcacatatcaaggtgtctgtttaaataatccaggagaagatttccaaacttatggaaataatcatcatactattattgaattcaaaaataaatattacattttctatcataccgaatggcttaataagcaagttttcggaactcaaaagggttatcgtacttcctttgttaatgaaattacattcagtaatggcaaatttgaaaaagctaagggtacctacgaaggtgtatcaca

SEQ ID NO: 25191 - DNA, 1641 bp, Neocallimastix californiae
  GLYCOSYL HYDROLASE 43 FAMILY MEMBER
tcaaaccaccgtaagaaaccctatcatatgggctgatgttcctgatgatgatatcatcagagttgatgatacttattatatggtaagtacaacaatgttctttagtccgggtgctcctattatgaagtcaaaggatctcttttcatgggaaatttgcaactatgtttatgatatccttgctgatggtgacgttcaaactcttaagaatggaaagcatgattattctcatggtcaatgggctgctagtttacgttatcatgagggtactttttatgtcttctttggtagttatggtactaataagtcatatatctttaaaaccaaagatattgaaaaaggtacttggactcgtaatgaaatctttggtatgtatcatgatgcttcaattctctttgatgatgacggtaggaagtatctcgtctatggtggtagtggtgaaatcaaaattaaagaatttaacaatgaaatgaccgacttcaagagaggtggtgctgataaagttttatttagaactggtctttctggtcttgctggtgaaggttctcatattcaaaaaattggtaaatattactatatatttattattgcttggccaaatggaaagggtcgtattgaaatttgttaccgtagtagagatcttcttggaaattatgaaaacaagattgttcttgattccggtttaggttcctatggaagtggtgtagctcaaggtggaatcgttgatacacctgatggtaaatggtatggtcttttattccaagatcatggttctgttggtagaattccagtacttgttccagtcaattggcaaaatgattggccaataatgggtgttaacggtaaagcaccattaactttccaaattgaaggtaatttcaaaggtactcaacttgctaagagtgatgatttcgactacagttccaataggttatccttagaatggcaatggaatcataatcctgataatactgcttggtctgtaaccgatcgtccaggttggttaagacttaagaataagtatattgctccagaacttcttaaggcaagaaatactcttaccatgcgtacagaaggtcctgcctgtagtggtgttgtaaaacttgatacttctaatatgaaggttggtgattatgctggtctttctgctttccaatataactatggtaatgttggtgtttatgttgctgataatggtgaaagacgtatttacatggcaagtaatggcggttataatggtaatgctgatgttaccaacagtagaaataatattgttcaagaagtcaaattaaatggtaaagagatttatctaaagaccgattttcgtttcagtactgttaagagcgatggtagtgcttcaaataatatcgataaagttaatttctattactcccttgatggtaatcaatggaataagattggtaaagaaattggaatgacttatgatcttaagcttttcacaggttacagaaatgctcttttcagttatccaacaaagaatactggaggttatgctgatttcgattactttgaatatcaacgcgaagaatggaactctccaaattttgctgaagaagaaaaagaagatccaaatggttacttattccataacacatttgaaagaggtatagatggttggagtag

SEQ ID NO: 25192 - DNA, 891 bp, Neocallimastix californiae
  GLYCOSYL HYDROLASE 43 FAMILY MEMBER
tcctttaattactcatagatatagtgcagatccaggtgttatggtttacaatggtagagtttatgtttatgcaactaatgatggtgatgttgctaatagaaatgttggtgaaaataaatatgatcaaattaatactattaattgtatgtcatctgatgatttaattaactggatggatcacggaccaattccagctgctggtggtaatggtgctgccaaatgggctaaaaattcatgggctccaactgctgcttggaagaaaatcaatggtaaggataagtttttcctttactttgccaataacgctagtggtattggtgttttaactgccgattctccaactggtccattcaaggatccaattggtagagctcttatctcacgtcaaactccaaatagtaatgttgaatggctttttgatccagctgtttttgttgatactgatggtactggttatctttactacggtggtggtgttccacaaggtcaaaatgctaatccaagaactattcgtgttgccaagttaggaaatgatatgacaagtattcaaggtactccacaaatgattgatgctccatgggtatttgaagattcaggtattaataagattggtaacacttatgtttactcatactgtactaactgggctggaggtccatacggtaatgccagaattgcttacatgactagtaacaacccaatgagtggattcaaataccaaggtacttgtttcaacaatccaggagatttcttccaaactactggtaacaatcaccacactattattgaattcaagaataagtactacatcttctaccacgctgaatggcttaacaagcaagttttcggttctcaaaagggttaccgtactactcatgttgatgaattacc

SEQ ID NO: 25193 - DNA, 921 bp, Neocallimastix californiae
  GLYCOSYL HYDROLASE 43 FAMILY MEMBER
tccaatcaatgtattaaagtacagtgctgatccaggtgttatggtttatgatggtagagtttatgtttacgctactaatgatggtattggtgaaaatattggaaataacccaagagataacgattacagtcacattaacactattaatgttatgtcatctagtgatatggtaaactgggttgatcatggtacaattccagctgctggtaacagtggtgctgctaagtgggctggtaattcatgggctccatgtgctgctcacaaaaagattaatggtaaggaaaagttcttcctttactttgctaatagtggtaatggtattggtgttttaactagtgactctccaactggtcctttcgttgatccaattggtggaccacttgtttctcgtagtactctaaactgtaacagtattgtttggttatttgatccagctgttatggttgatgatgatggtactggttatctttacttcggtggtggtgttccagaaaatgctaagtctaacccaaaaactgttcgtgcagttaaattaggtaatgatatgattagtcttgctggtactccacaaactattgatgctccatgggtcttcgaagattctggtattaacaaggctggaaacacttacttctattcttactgtactaactgggataatggaccatacggtaatgctaagattgcttacatgactagtagcagtccattaggtccattccaataccaaggtactgttcttaacaacccaggagatttctttggaactgttggtaacaatcaccacaccattattaacttcaagaacaaatggtatatcttctatcacgctgaatggcttaacaaacaagtcttcggtagtcaaaagggtttccgtacttcacacgttgatgaattaccattcagtaacggtaaattcgg

SEQ ID NO: 25194 - DNA, 1113 bp, Neocallimastix californiae
  GLYCOSYL HYDROLASE 43 FAMILY MEMBER
tcatgatccgtctgtagttaagtatggtaataaatattatatatttggttcccacatggatactgcctatactaccgatttatggaagtttactaaattgtatactggtgttaatgataacaataaaatgtttacaaatttattttcaaaatcaaattatggtgcatttaattttgtaggaaaaaatagtgatggtggttattctgtttgggctcctgatattatatataataatagaatgaaaaaatgggttcaatatttttgtacatcttccacatatattaaatctagtatttgttacgctttagctgataacgttgaaggtccatacacttataaaaattgctttattttctctggtatggattcaaaaaccgttggtaaaactaatttgaaagctgttattggatatgaagatatgaatcgttattatccaaataacaaatacaataatagagtttatcccaatgcaattgatccaaatgcattttatgattttaaggggaagttatggcttgtttatggttcttggtcgggtggtatatatattttagaattagatgaaagtacaggtcttccaaaacacaatatttctaatggcaataatactgatagatactatggtaagaagcttgcaggtggtaatcaccaatctattgaaggtccatttattttaccacacaaagctgttggttattattatttatttgtatcctatggctctcttacgtcaaatggtggttaccaaattcgtatgttccgttctaaaaatccagatggtccatatacagatgttgctggaaaagaatttatgagtggtaataattcaagctttggtgttaaagtcatgggtaattataatattcctggaagagaacaggcatatatggctccaggccacaattctgctttacttgatgatgatggtaaagtgttaatattctatcatactcgttttaatgatggtcaagaatatcacgaaccacgtattcatcaaatgtttcttaataaggaaggatggttatgtgctgctccatatgcttatactggagaaactatttctgagactggttacagtatgaacgatatggttggaacatataaattcctatt

SEQ ID NO: 25195 - DNA, 835 bp, Neocallimastix californiae
  GLYCOSYL HYDROLASE 43 FAMILY MEMBER
tctcgttagcaacatgtacactgctgatccagccccaatggtttatggagatactctttatcttttcacttctcacgatgaaaacaacattcaaaacaacttctacactatgttaaactggcatcttttctcaacaaaggatatgattaactggactagtcatggacaagtcttctctttagatgatatcagctgggctgatgatagagcttgggctccacaagctattgctagaaatgataaattctatctttatgtaccagtacataaaagaaatggaggtatggccattgctgttggtgtttctgataaaccaactggtccatacaaggatattggtcatccacttgttgatgaaggtgattggaatgatattgatccaaccgttttcattgatgatgatggtcaagcttacttatacttcggtaatccagaacttagatacgttcttttgaacgaagatatggtttcttacaacaaatctgttggtgttaagaagattccaatgactgctgattccttcggaagaggtgaaggtagccgtactacttatggcgaaggtccattcttctacaaaagaaaggatatgtactatatggcttacgctgctttcagaccaaataagggtagtgaacatcttgcttattcttactctaattcaccaactggtccatggaagtacggtggtgttcttatgactgaagatggtggtacatacactaatcacccaggtattgctagattcaagggacgttcatacctcttttaccacactggtcaacttccaggtggtggtgcttaccacagaagtgtatgtttcactgaattcaaatac

SEQ ID NO: 25196 - DNA, 627 bp, Neocallimastix californiae
  GLYCOSYL HYDROLASE 43 FAMILY MEMBER
aagattaaaaaataaatatgttgtaagtgaacttcttagagctagaaatactttaactatgcgtactgaaggtccagcatgtactagtattgttaaaatggatacttctaaaatgaaagttggtgattatgctggtctttctgccttccaatttaaatatggtaatgttggtgtttatgttgctgataatggtgaaaaacgtgtttatatggcaactaatggtggtaatgaaattaataatagtagaaattatattgaacaagaaactcgtatgtctggtaatgaaatttatcttaaattagaattccgtttcaataatgttggaaatgatggtagtgcctcaaacaatattgatagagttaatttctattattcttatgatggtgataaatggaccaagattggtaaggaacttggtatgacctatgatcttactcttttcactggttatcgtagtgctctttacagttacccaactaaatctactggtggttatgttgattttgattatattaaatatacacgtgaaaaatggaatcaaggtacccttccagatgatgctgatgatgatattaaaccacaacccattgaaccagatgaaaatggttattatttccataatacttt

SEQ ID NO: 25197 - DNA, 921 bp, Anaeromyces robustus; identical to SEQ ID NO: 25193
  GLYCOSYL HYDROLASE 43 FAMILY MEMBER

SEQ ID NO: 25198 - DNA, 870 bp, Anaeromyces robustus
  GLYCOSYL HYDROLASE 43 FAMILY MEMBER
tctcgttagcaacatgtacactgctgatccagccccaatggtttatggagatactctttatcttttcacttctcacgatgaaaacaacattcaaaacaacttctacactatgttaaactggcatcttttctcaacaaaggatatgattaactggactagtcatggacaagtcttctctttagatgatatcagctgggctgatgatagagcttgggctccacaagctattgctagaaatgataaattctatctttatgtaccagtacataaaagaaatggaggtatggccattgctgttggtgtttctgataaaccaactggtccatacaaggatattggtcatccacttgttgatgaaggtgattggaatgatattgatccaaccgttttcattgatgatgatggtcaagcttacttatacttcggtaatccagaacttagatacgttcttttgaacgaagatatggtttcttacaacaaatctgttggtgttaagaagattccaatgactgctgattccttcggaagaggtgaaggtagccgtactacttatggcgaaggtccattcttctacaaaagaaaggatatgtactatatggcttacgctgctttcagaccaaataagggtagtgaacatcttgcttattcttactctaattcaccaactggtccatggaagtacggtggtgttcttatgactgaagatggtggtacatacactaatcacccaggtattgctagattcaagggacgttcatacctcttttaccacactggtcaacttccaggtggtggtgcttaccacagaagtgtatgtttcactgaattcaaatacaataaggatggtagtattgatactattccaatgtg

SEQ ID NO: 25199 - DNA, 1560 bp, Anaeromyces robustus
  GLYCOSYL HYDROLASE 43 FAMILY MEMBER
aacagtttataatccaattatctgggcagatgtacctgatccagatattattagagttgatgatacttactatatggtaagtactactatgttttttaatccaggtgctccaataatgaaatcaaaagatcttgtttcatggaaaatttgtaattatgtttatgataaacttgctgatggtgatgttcaaaatcttgcaagaggtcaacatgattattctcatggtcaatgggctactagtttacgttatcataaaggaactttctatgttttctttggtagttatggtactaataaatcttacatttttaaaacaaaagatatagaaaatggtccatggactcgtactgaacttggtggtatgtatcatgatgcttctatgatttttgatgatgatggtagaaattatcttgtttatggagctggtggtgaaattagaattaaagaatttaattctgaaatgaccgattttaagagaggtggtgccgataaaattttatttagaactaacctttcaggtcttgctggtgaaggttctcatgttcaaaaaattaataattattattatattttcattattgcttggccaaatggtaaaggtcgtattgaaatttgttaccgtagtaaagatattcttggtaattatgaaagtagaactgtattagattctggtgttggttcttatggtagtggtgttgcccaaggtggtattgttgatactccagaaggtaaatggtatggtttacttttccaagatcatggttctgttggtagaattccagttcttgttccagttaactggcaaagtgattggccaatgatgggggttaatggtagagctccagtaactttccaaattgatggagatttcaaaactactaaattagctaaaagtgatgatttcaattatagtagtaatgatgaattagatttagtttggcaatggaatcataatccagataattctgcttggtctgttactgaacgtgaaggttggttaagattaaaaaataaatatgttgtaagtgaacttcttagagctagaaatactttaactatgcgtactgaaggtccagcatgtactagtattgttaaaatggatacttctaaaatgaaagttggtgattatgctggtctttctgccttccaatttaaatatggtaatgttggtgtttatgttgctgataatggtgaaaaacgtgtttatatggcaactaatggtggtaatgaaattaataatagtagaaattatattgaacaagaaactcgtatgtctggtaatgaaatttatcttaaattagaattccgtttcaataatgttggaaatgatggtagtgcctcaaacaatattgatagagttaatttctattattcttatgatggtgataaatggaccaagattggtaaggaacttggtatgacctatgatcttactcttttcactggttatcgtagtgctctttacagttacccaactaaatctactggtggttatgttgattttgattatattaaatatacacgtgaaaaatggaatcaaggtacccttccagatgatgc

SEQ ID NO: 25200 - DNA, 894 bp, Anaeromyces robustus
  GLYCOSYL HYDROLASE 43 FAMILY MEMBER
cccagtagtttctcacagatacagtgcagatccaggtgctatggtttatgatggtagagtttatatttatggtagtaatgatggtaatgttgctgaaagacaaggtaaaacaaatgattattctcaaattaaaacaattaatcttttatcatcatctgatttagttaattggatggatcacggtccaattccagcaactggacaaagtggtattgctaaatttgctagtaattcatgggctccagctgcttgtcacaaaaaaattaatggtaaagaaaaattctttgtttactttgctaacaatgctagtggtatttgtgttttagaatctgattctccaactggtccattcaaggatcctcttggaaaaccacttattactagacaaactccaaactcaaatgtagaatggcttttcgatccagcttgtttagttgatgatgatggtactggttacctttacttcggtggtggtgttccaaatggtcaagccgctaacccaagaactgttcgtgttgtcaaattaggagctgatatgaagagtcttgctggaaccccacaaacaattgatgctccatgggtattcgaagattctggtattaataaggttggtaacacttactactacaactattgtaccaactttaatggaggtccatacggtaatggtagaattgcttacatgagtagtaacagtccaatgggtccattcagttacaagggtacttgctttaacaaccaaggtgatttcttacaagatggtggaggtaacaatcaccacactattattgaatttaagaacaaattttacatggtctatcacgctcaatggcttgatatgaaggttaaaggtaaatcaaatggataccgtactactcacattgatgaattacc

SEQ ID NO: 25201 - DNA, 1266 bp, Anaeromyces robustus
  GLYCOSYL HYDROLASE 43 FAMILY MEMBER
tcatgatccatctgttattaagaatggtaataagtattatattttcggttcacatatggatactgcttatactaccgatttatggaaatttactaaattatatacaggtgtcaatgaaaataatagaatgtttactaatttattctctaaatcaaattatggtgcattcaattttgttggtaaaaacagtgaaggtggatattctgtatgggctccagatgttatgtataacaaaaaaatgcgtaaatgggtacaatatttctgtacatcttctacttatattaaatcaagtatttgttatgctttagctgataatgttgaaggtccatacacttatcaaagttgtttcattttctctggtatggattctggaagtgttggaaagactaatttaagagctgttactggtactgaagatggaaatcgttattatccaggtaataaatataataatagagtttatccaaatgctattgatccaaatgtattctatgatttcaatggtagactttggcttgcttatggttcatggtctggaggtatttacattttagaattagatgaaagtacaggtcttccaaaacataatattagtaatggtactaatattgataaatattatggtaagaaacttgctggtggtggtcaccaatctattgaaggtccatacattttaccatataaagctgctggttattactatttatttgtttcatatggtactcttacttctaatggtggttaccaaattcgtttattccgttctaaaaacccagatggtccatatactgatccagctggtaatgaattcatgggtggtactaattcaaactttggtcttaagcttatgggtaattacaatattccaggtagaagtcaagcctatatggctccaggtcataattctgctatgattgatgacaatggaaaggttttaatgttctatcatactcgtttcaatgatggacaagaatatcatgaaccacgtgttcatcaattattccttaataaggaaggttggttctgtgttgctccatatgcttacactggagaaactatttctactactggttatggattgaatgatataattggtacctacaaaatgttattccacttccatacaagaattaatggtgatatttctaatctttatactattgatttaaatgaagactttactgttactggtagatatactggtacttggtcttatgataagggtactcaatatatgactattactattggtaagattatttacag

SEQ ID NO: 25202 - DNA, 846 bp, Anaeromyces robustus
  GLYCOSYL HYDROLASE 43 FAMILY MEMBER
tcctttaataactcatagatatagtgctgatcctggtgttatgatttacaatgatagagtttatgtatattcaaccaatgatggagatgttgatcttaataataaaaatgttaatggaaatacctatgaccatattaaaagtcttaatgttatgtcttcttcagatttagttaattggcaagaccatggttctattaatgttgcaggtggtgctgctaaatgggctcaatattcatgggctccatgtgctacctataaaaaaattaatggtaaagataaatttttcctttactttgctaataatgctaatggtgttggtgttttaactagtgattctccaactggtcctttcactgatccaattggtaaagctcttatttctcgtgatacaccaaattgtggtgatgttacttggctttttgatccagctgttttagttgatgatgatggtactggttatctttactttggtggtggtgtaccaaatggtatggatgctaatccaaaaactattcgtgttgttaaattaggaagtgatatgattagtcttgctggtcaaccacaattaattgatgctccatacgtttttgaagattctggtattaataaaattggtaatacctatttctattcttattgtactaattggactggtggtcaatatggtggtgctaatattgcttttatgactagtaatagtccaatgggtccatttaaagctggaagttcctgtttcaaaaatccaggagaatttttaggtaattatggtaataatcatcatactattattcaatttaaaaataaatggtacattttctatcataccgaatggcttaataaaattgt

SEQ ID NO: 25203 - DNA, 894 bp, Anaeromyces robustus
  GLYCOSYL HYDROLASE 43 FAMILY MEMBER
tccattgattactcatagatatagtgcagatccaggtgttatggtttacaatgatagagtttatgtttatgccacaaatgatggtgatgttgctaatagaaatgttggtgataatacatatgaacaaattaatactattaattgtatgtcttcagatgatttagttaactggactgatcatggaccaattgctgctgctggtcaaggtggtgcagctaaatgggctaaaaattcatgggctccaactgctgcccataaaactattaatggtaaggaaaaattcttcctttactttgctaacagtggtgctggtattggtgttttagttagtgactctccaactggtccattcactgatccaattggtaaagctcttattactccacaaactccaaattgtgctagtgttacttggcttttcgatcctgctgttttagtcgatactgatggtactggttatctttactttggtggtggtgtcccacaaggtcaagatgctaatccaaaaactattcgtgttgttaaattaggtccagatatgacaagtcttgctggtaatccagaaactattgatgctccatgggtattcgaagattctggtattaataagattggtaatacttatgtttactcttactgtactaactgggctaatggtccacatggtaatgctagaattggttatatgacaagtaatagtccaatgggtccattcactttccaaggtacttgtttcaacaacccaggtgatttcttccaaactactggtaataatcatcacactattattgaattcaagggtaaatattatatcttctatcacacagaatggcttaacaaacaagttttaggtagtcaaaagggttatcgtaccactcatgttaatgaaatgcc

SEQ ID NO: 25204 - DNA, 894 bp, Anaeromyces robustus
  GLYCOSYL HYDROLASE 43 FAMILY MEMBER
tccaataattactcatagatatagtgctgatccaggtgttatggtttataatggtagagtttatgtttatgccactaatgatggtgatgttgctaatagaaatgttggtgataatacatatgaacaaattaatactattaattgtatgtcttcagatgatttagttaactggactgatcatggaccaattaaggctgctggtcaaggtggtgcagctaaatgggctaaaaattcatgggctccacatgctgctcacaaaactattaatggtaaggaaaaattcttcctttactttgctaacagtggtgctggtattggtgttttagttagtgattctccaactggtccattcactgatccaattggtaaagctcttgttactccacaaactccaaattgttctagtgttacttggcttttcgatcctgctgttttagttgattctgatggtactggttatctttactttggtggtggtgtcccacaaggtcaaaattctaatccaaaaactattcgtgttgttaaattaggtccagatatgacaagtcttgctggtaatccacaaactattgatgctccatgggtatttgaagattctggtattaataaggttggtaatacttatgtttactcttactgtactaactgggctaatggtccatatggtaatgctagaattgcctatatgacaagtaacagtccaatgggtccattccaatatcaaggtacttgtttcaacaacccaggtgatttcttccaaactactggtaataatcatcacactattattgaatttaaggataaatattatatcttctatcacacagaatggcttaacaaacaagttttaggtagtcaaaagggttatcgtaccactcatgttaatgaaatgcc

SEQ ID NO: 25205 - DNA, 864 bp, Anaeromyces robustus
  GLYCOSYL HYDROLASE 43 FAMILY MEMBER
cattacttcaatgtacacagctgatccagctccattaattgttgatgatactctttacatttacactactcatgatgaagatgttcttataaacaatttctatactatgagagattggtatgtattctctactaaggatatggttaactggactaatcatggtccaatcctctctttagatgatattacttgggctgatgacagagcttgggctccacaaactattgaaagaaatggtaaatactacttctattacccagctcataagattgatggtggtatggctgttggtgttgctattggtgactctccagttggtccattcaaagatattggcgaaccacttgtttatcaagatgattggattgatttcgatccaactgttttcattgatgatgatggtcaagcctacttatactttggtaatccacaacttagatatgttctcttaaatgaagatatggtttcttacaatgaagaagttggtattgttgatgttgaattaactgttgaaggttttggtgaaggtaataataacccaacctcttatgatgaaggaccattcttctataagagaaatggtatttattatatgttattctctggtttcagaaagggttacgaatctgaatacattggttacgctacttcaacttctccaactggtccatggaagtatggtggtattcttatggaagaacatgaagacaaaactttcactaatcactcatctattgttgaattcaatggtcacacctacttcttcttccacactggtgaccttccagatggtggtgacttccacagaagtgttgcttacatcgaatttgaatacaatgaagatggttccattaacccaattac

SEQ ID NO: 25206 - DNA, 864 bp, Anaeromyces robustus; identical to SEQ ID NO: 25205
  GLYCOSYL HYDROLASE 43 FAMILY MEMBER

SEQ ID NO: 25207 - DNA, 1005 bp, Piromyces finnis
  GLYCOSYL HYDROLASE 43 FAMILY MEMBER
tccagctgtatttgttgatgatgatggtactggttacctttacttcggtggtggtgttccagaaggtcaagctagtgacccaagaaccactcgtgctgctaagttaggtgatgatatgattagtattgatggtattccacaaaccattgaagctccatgggtctttgaagactctggtattaacaaggttggtgactcttacgtctactcttactgtgtcaactgggataacggaccatacggtaatgctaagattgcttacatgactagtgaaaatccattaggtccattcaccttccaaggtactcttcttaacaacccaggtgatttcttcggaactaccggtaacaaccaccacactattattgaattcaagggtaagtggtacatcttctaccacgctgaatggctcaatgtccaagtctacggaagtcaaaagggttaccgtaccactcacgttgatgaacttccattcttcaatggaaacttccgtaatgctactggtactcttgctggtgttgaacaattatcaaatgttgatgcctacagtaccaactacgcctcaatgatggcttggcaagctggtgtttccgtttatggtttaggtcacaccactgttacctacagaaagggtacctggactggtgtttctggtgttgaatttggtgacaatgccacttccgttaagatttcagctgcctctgccaatggtgctactattagaatcacctctggaagtgaaaacggtgaagttattggttacgttaccgttccagctactggtgatgaattcgtcactgttactgctgatgttagtgtttctggtgttaaggacatcttctttgttgcctctgacgaagttgttgtcgatacctggcaatttgttgctgatgaagctatcagtagtgctgatgaagaaattgaagttgatggtgatgacgaaatcaatgttggtgaagtcgacagtgctgacgaagaaattgacagtgctgatgaagaaatttg

SEQ ID NO: 25208 - DNA, 861 bp, Piromyces finnis
  GLYCOSYL HYDROLASE 43 FAMILY MEMBER
actcatcactaatatgtacactgctgatccagctccaatggtttacggtgataccctttacctttacactactcacgatgaaaacaaccttaaaaacaatttctacactatgcttgattggtacgttttctccactaaggatatggttaactggactaaccatggtaagattttctctttagatgatattagctgggctgatgacagagcttgggctccacaagctattgaaagaaacggtaaattctacctttactgtccagttcacaaaactaacggtggtatggctattgctgtcggtgtttctgacaagccaaccggtccatttaaggatattggtcatccacttgttgatgaaggtgactggaacgatattgacccaactgttttcattgatgatgatggtcaagcttacttatacttcggtaacccagaacttagatatgttcttttgaacgaagatatgatttctatcaataaatctgttggtgttaagaagattaagatgactgaagaagccttcggtaagggtagtcacgataccggtacaacttatggtgaaggtccatacttctacaagagaaacggtatttattacatggcctatgctgccttcagacaaggtaagaacattgaatctcttggttactctacttctacttctccaactggtccatggaagtacggtggtccacttatgactgaagaaggtggtgctttcactgttcacccaggtattgttgatttcaagggtcattcttacctcttctaccacactggtgaacttccaggtggtggtgacttccacagaagtgttggtttcgctgaattcagatataataaggatggttctattccagt

SEQ ID NO: 25209 - DNA, 1266 bp, Piromyces finnis
  GLYCOSYL HYDROLASE 43 FAMILY MEMBER
tcacgatccatctgttgtcaaaaatggtaataaatattatattttcggttctcatatggatactgcttttactactgatttatggaagtttacaaagttatatacaggtgttaatgaaaacaataaaatgttttcaaatttattctcaaaatcaaattatggtgctttcaactttgttggtaaaaatagtgaaggtggattctcagtttgggctccagatgttatgtttaataagagaatgaataaatgggttcaatatttctgtacttcttctacatatattaaatccagtatttgttatgctttagctgataatattgaaggtccatacacttataaggattgcttcatcttctctggtatggattcaggtagtgttggtaaaacaaatattagagctattactggtagtgataacggtaatcgctatttcccaggtaacaaatacaataataaggtctatccaaatgccattgatccaaatgcattctacgatttcaatggtaaattatggttggcttatggttcatggtctggtggtatctatatcttagaattagatgaaagtactggtcttccaaaacataacatcaataatggaaataacatagataaatactatggtaagaagttagctggtggtaatcatcaatctattgaaggcccatacattttaccacataaagctgctggatattactatcttttcgtttcctatggtactcttacatctaacggtggttaccaaattcgtttattccgttcaaagaacccagatggtccatatactgatgctgctggtagagaatttatgagtggtactaattccaactttggtgtcaagattatgggtaattacaatattccaggaagaagccaagcttacatggctccaggtcacaattctgctttaattgatgacaatggaaaaatcttactcttctatcacactcgtttcaatgatggtcaagaatatcacgagccacgtattcatcaaatgttccttaacaaggaaggatggcttgttgctgctccatatgcttacactggtgaaaccatttctccaactggttatagtatgaatgatatggttggtagttacaagttattattccacttccatactagaattaatggtgaaatttctaatctctacaccattaacttaaaccaagactttactgttactggtaaatacactggtacttggtcttatgataagggtactcattacatgaccattactctcaataactacacttatag

SEQ ID NO: 25210 - DNA, 900 bp, Piromyces finnis
  GLYCOSYL HYDROLASE 43 FAMILY MEMBER
cccagtcaacactcttaaattcagtgctgatccaggtgtaatggtttatgatggtagagtttacgtttatgctactgatgatggtcatgttgatcaattaggtaacaacccagaaactaacacttatggacaaattaacaccattaatgttatgtcttctgatgatttagttaactggattgaccatggttccattccagcagcaggtagaaatggagcagctaagtgggctaacaactcatgggcaccaaccgcagctcacaaaaagattaatggtaaggaaaagttcttcctttactttgctaacagtggtaatggtgttggtgttttaagtagtgattctccaacaggtccatttgttgatccaattggtggaccacttgtttcatttgatgttccaaactgtggtgatattgtttggttattcgatccagctgtatttgttgatgatgatggtaaaggttatctttactttggtggtggtgttccaactggtcaagatgctaatccaaagactattcgtgtcgttcaattaggagatgatatgactagtattgttggtaccccacaattaattgatgctccatacgttttcgaagattctggtattaataagatcggtaacacttatatttattcttactgtactaattgggctaatggtccatatggtagtgctaatattgcatacatgacaagtagcagtccaatgggtccattcaaaatgcaaaaatcatgtttcaagaatccaggtgaatactttggtaactatggtaacaaccatcacactatgattgaattcaagggtaaaaactacattttctaccacactgaatggcttaataaggaagttttcggtactcaaaagggttatcgtacttctcatgttgatgaaatgcc

SEQ ID NO: 25211 - DNA, 915 bp, Piromyces finnis
  GLYCOSYL HYDROLASE 43 FAMILY MEMBER
taccaatcacaacccattaatgacttatagatacggtgctgacccaggtgtttttgtatacgatggtagagtttatgtcttcactacaaatgatggtgatgttgaccttactaacaaaaatattgcagaaaacacttattcacacattcaaacccttaatcttatttcttctgctgatttagttaattggaccgaccacggttctattagtgttgcaggtaataatggtgctgctaaatgggctcaatattcatgggctccatgcgctacctacaaaaagattaatggtaaagataaattcttcctttacttcgctaataatgctaatggtattggtgttttaactagtgattctccaactggtccatggaaggatccaattggtaaggcacttattactcgtcaaactccaaactgtaatgtcgaatggttattcgatccagctgtatttgttgatgatgatggtactggttacctttacttcggtggtggtgttccagaaggtcaagctagtgacccaagaaccactcgtgctgctaagttaggtgatgatatgattagtattgatggtattccacaaaccattgaagctccatgggtctttgaagactctggtattaacaaggttggtgactcttacgtctactcttactgtgtcaactgggataacggaccatacggtaatgctaagattgcttacatgactagtgaaaatccattaggtccattcaccttccaaggtactcttcttaacaacccaggtgatttcttcggaactaccggtaacaaccaccacactattattgaattcaagggtaagtggtacatcttctaccacgctgaatggctcaatgtccaagtctacggaagtcaaaagggttaccgtaccactcacgttgatgaacttccattctt

SEQ ID NO: 25212 - DNA, 900 bp, Piromyces finnis
  GLYCOSYL HYDROLASE 43 FAMILY MEMBER
tccattaattacccacagatacagtgctgatccaggtgttatggtctatgatggtagagtttacgtttacggtactaatgatggtcatgccgatgagttaggtgataatccagaagataacacttaccaacaaattaacactattaatgttatgtcttctgacgatttaattaactgggttgatcacggttccattccagcagccggtgaaaatggtgctgctaagtgggctgtcaactcatgggctccagctgctgctcacaagaagattaatggtaaggaaaagttcttcctttactttgctaacagtggtaatggtgttggtgttttaagtagtgattctccaacaggtccatttgttgatccaattggtggaccacttgtttcatttgatgttccaaactgtggtgatattgtttggttattcgatccagctgtatttgttgatgatgatggtaaaggttatctttactttggtggtggtgttccaactggtcaagatgctaatccaaagactattcgtgtcgttcaattaggagatgatatgactagtattgttggtaccccacaattaattgatgctccatacgttttcgaagattctggtattaataagatcggtaacacttatatttattcttactgtactaattgggctaatggtccatatggtagtgctaatattgcatacatgacaagtagcagtccaatgggtccattcaaaatgcaaaaatcatgtttcaagaatccaggtgaatactttggtaactatggtaacaaccatcacactatgattgaattcaagggtaaaaactacattttctaccacactgaatggcttaataaggaagttttcggtactcaaaagggttatcgtacttctcatgttgatgaaatgcc

SEQ ID NO: 25213 - DNA, 1776 bp, Piromyces finnis
  GLYCOSYL HYDROLASE 43 FAMILY MEMBER
cccagtcaacactcttaaattcagtgctgatccaggtgtaatggtttatgatggtagagtttacgtttatgctactgatgatggtcatgttgatcaattaggtaacaacccagaaactaacacttatggacaaattaacaccattaatgttatgtcttctgatgatttagttaactggattgaccatggttccattccagcagcaggtagaaatggagcagctaagtgggctaacaactcatgggcaccaaccgcagctcacaaaaagattaatggtaaggaaaagttcttcctttactttgctaacagtggtaatggtgttggtgttttaagtagtgattctccaacaggtccatttgttgatccaattggtggaccacttgtttcatttgatgttccaaactgtggtgatattgtttggttattcgatccagctgtatttgttgatgatgatggtactggttacctttacttcggtggtggtgttccagaaggtcaagctagtgacccaagaaccactcgtgctgctaagttaggtgatgatatgattagtattgatggtattccacaaaccattgaagctccatgggtctttgaagactctggtattaacaaggttggtgactcttacgtctactcttactgtgtcaactgggataacggaccatacggtaatgctaagattgcttacatgactagtgaaaatccattaggtccattcaccttccaaggtactcttcttaacaacccaggtgatttcttcggaactaccggtaacaaccaccacactattattgaattcaagggtaagtggtacatcttctaccacgctgaatggctcaatgtccaagtctacggaagtcaaaagggttaccgtaccactcacgttgatgaacttccattcttcaatggaaacttccgtaatgctactggtactcttgctggtgttgaacaattatcaaatgttgatgcctacagtaccaactacgcctcaatgatggcttggcaagctggtgtttcagttaatggtttaggacacaccactgtttcttacaacagaggtgattggactggtgtttctaacgttgactttggagacagtgccacttccgtaaagatatccgccgcttccagcaatggagccaccattagaattacttcaggcagtgaaaatggtgatgttattggatacgttactattccagctacaggtggtgataagaacttcaagaccgttacagctaatgttaaggcttctggtactaagaacatcttctttgttgcctctggtgatgttactattgatacctggcaattcattggatcaggtaagggatccaacgaaccaattgaatttggagatggtgaacttccatcaagcaagccagttgccgtcaagattgaagatggttggtattacattaagaacccagcttcaggtaaatacctccaagttgctaataaccaagctaaggctacagccaatattgaaattggatcatctagtcaagatgatggacaaaagtggttacttactaatgttggtgaaggttatgttaccttaaagagtgctcttggcgatttcatgattgatgttagtagtggtgaagacaagaatggagccaatattcaaatctacactgcctatggtcacgatgctcaacaattcatgatcttaaaatctagtgttgaaggagcctacagtattacttcaagagttagtttccaagacaagggtattgatattgaaggagctcgtacagctgatggtaccaa

SEQ ID NO: 25214 - DNA, 900 bp, Piromyces finnis; identical to SEQ ID NO: 25210
  GLYCOSYL HYDROLASE 43 FAMILY MEMBER

SEQ ID NO: 25215 - DNA, 915 bp, Piromyces finnis; identical to SEQ ID NO: 25211
  GLYCOSYL HYDROLASE 43 FAMILY MEMBER

SEQ ID NO: 25216 - DNA, 1776 bp, Piromyces finnis
  GLYCOSYL HYDROLASE 43 FAMILY MEMBER
tccattaattacccacagatacagtgctgatccaggtgttatggtctatgatggtagagtttacgtttacggtactaatgatggtcatgccgatgagttaggtgataatccagaagataacacttaccaacaaattaacactattaatgttatgtcttctgacgatttaattaactgggttgatcacggttccattccagcagccggtgaaaatggtgctgctaagtgggctgtcaactcatgggctccagctgctgctcacaagaagattaatggtaaggaaaagttcttcctttactttgctaacagtggtaatggtattggtgttttaagtagtgattcaccaaccggtccatttaccgatccacttggtggaccaattatttcacgtagtcttccaaactgtaataacattgtttggttatttgatccagctgtttttgttgatgatgatggtacaggttacatttactttggaggaggtgttccagaaggacaatctagcaatccaaagacagtccgtgctgccaagttaagtgatgatatgattagaatttccggtactccacaaaccattgatgctccatgggtctttgaagattcaggtattcacaagtatggcgatacttacttctactcctactgtactaactgggataatggaccatacggtaatgccaagattgcctacatgaccagtaagagtccattaggaccattcacataccaaggtactcttttcaacaacccaggtgaattctttggtactactggtaacaatcaccacactattattgaattcaagggtaagtggtacatcttctaccacgctgaatggctcaatgtccaagtctacggaagtcaaaagggttaccgtaccactcacgttgatgaacttccattcttcaatggaaacttccgtaatgctactggtactcttgctggtgttgaacaattatcaaatgttgatgcctacagtaccaactacgcctcaatgatggcttggcaagctggtgtttcagttaatggtttaggacacaccactgtttcttacaacagaggtgattggactggtgtttctaacgttgactttggagacagtgccacttccgtaaagatatccgccgcttccagcaatggagccaccattagaattacttcaggcagtgaaaatggtgatgttattggatacgttactattccagctacaggtggtgataagaacttcaagaccgttacagctaatgttaaggcttctggtactaagaacatcttctttgttgcctctggtgatgttactattgatacctggcaattcattggatcaggtaagggatccaacgaaccaattgaatttggagatggtgaacttccatcaagcaagccagttgccgtcaagattgaagatggttggtattacattaagaacccagcttcaggtaaatacctccaagttgctaataaccaagctaaggctacagccaatattgaaattggatcatctagtcaagatgatggacaaaagtggttacttactaatgttggtgaaggttatgttaccttaaagagtgctcttggcgatttcatgattgatgttagtagtggtgaagacaagaatggagccaatattcaaatctacactgcctatggtcacgatgctcaacaattcatgatcttaaaatctagtgttgaaggagcctacagtattacttcaagagttagtttccaagacaagggtattgatattgaaggagctcgtacagctgatggtaccaa

SEQ ID NO: 25217 - DNA, 909 bp, Piromyces finnis
  GLYCOSYL HYDROLASE 43 FAMILY MEMBER
taccaatcacaacccattaatgacttatagatacggtgctgacccaggtgtttttgtatacgatggtagagtttatgtcttcactacaaatgatggtgatgttgaccttactaacaaaaatattgcagaaaacacttattcacacattcaaacccttaatcttatttcttctgctgatttagttaattggaccgaccacggttctattagtgttgcaggtaataatggtgctgctaaatgggctcaatattcatgggctccatgcgctacctacaaaaagattaatggtaaagataaattcttcctttacttcgctaataatgctaatggtattggtgttttaactagtgattctccaactggtccatggaaggatccaattggtaaggcacttattactcgtcaaactccaaactgtaatgtcgaatggttattcgatccagctgtatttgttgatgatgatggtaaaggttatctttactttggtggtggtgttccaactggtcaagatgctaatccaaagactattcgtgtcgttcaattaggagatgatatgactagtattgttggtaccccacaattaattgatgctccatacgttttcgaagattctggtattaataagatcggtaacacttatatttattcttactgtactaattgggctaatggtccatatggtagtgctaatattgcatacatgacaagtagcagtccaatgggtccattcaaaatgcaaaaatcatgtttcaagaatccaggtgaatactttggtaactatggtaacaaccatcacactatgattgaattcaagggtaaaaactacattttctaccacactgaatggcttaataaggaagttttcggtactcaaaagggttatcgtacttctcatgttgatgaaatgcc

SEQ ID NO: 25218 - DNA, 900 bp, Piromyces finnis
  GLYCOSYL HYDROLASE 43 FAMILY MEMBER
cccagtcaacactcttaaattcagtgctgatccaggtgtaatggtttatgatggtagagtttacgtttatgctactgatgatggtcatgttgatcaattaggtaacaacccagaaactaacacttatggacaaattaacaccattaatgttatgtcttctgatgatttagttaactggattgaccatggttccattccagcagcaggtagaaatggagcagctaagtgggctaacaactcatgggcaccaaccgcagctcacaaaaagattaatggtaaggaaaagttcttcctttactttgctaacagtggtaatggtgttggtgttttaagtagtgattctccaacaggtccatttgttgatccaattggtggaccacttgtttcatttgatgttccaaactgtggtgatattgtttggttattcgatccagctgtatttgttgatgatgatggtaaaggttatctttactttggtggtggtgttccaactggtcaagatgctaatccaaagactattcgtgtcgttcaattaggagatgatatgactagtattgttggtaccccacaattaattgatgctccatacgttttcgaagattctggtattaataagatcggtaacacttatatttattcttactgtactaattgggataatggaccatatggtaatgctagaattgcatacatgactagtaacagtccaatgggaccattcagttacaaaggtacatgtttcaacaatccaggagatttcttccaaactactggtaataatcaccacactattattgaatttaaaaacaaatattatattttctatcacactgaatggcttaacaagcaagttttcggtagtcaaaagggttatcgtactactcatgttaatgaaatgcc

SEQ ID NO: 25219 - DNA, 1776 bp, Piromyces finnis; identical to SEQ ID NO: 25213
  GLYCOSYL HYDROLASE 43 FAMILY MEMBER

SEQ ID NO: 25220 - DNA, 1434 bp, Piromyces finnis
  GLYCOSYL HYDROLASE 43 FAMILY MEMBER
cccacttagtactcttaaatacagtgctgatccaggtgttatggtctatgatggtagagtttacgtttacggtactaatgatggtcatgccgatgagttaggtgataatccagaagataacacttaccaacaaattaacactattaatgttatgtcttctgacgatttaattaactgggttgatcacggttccattccagcagccggtgaaaatggtgctgctaagtgggctgtcaactcatgggctccagctgctgctcacaagaagattaatggtaaggaaaagttcttcctttactttgctaacagtggtaatggtgttggtgttttaagtagtgattctccaacaggtccatttgttgatccaattggtggaccacttgtttcatttgatgttccaaactgtggtgatattgtttggttattcgatccagctgtatttgttgatgatgatggtactggttacctttacttcggtggtggtgttccagaaggtcaagctagtgacccaagaaccactcgtgctgctaagttaggtgatgatatgattagtattgatggtattccacaaaccattgaagctccatgggtctttgaagactctggtattaacaaggttggtgactcttacgtctactcttactgtgtcaactgggataacggaccatacggtaatgctaagattgcttacatgactagtgaaaatccattaggtccattcaccttccaaggtactcttcttaacaacccaggtgatttcttcggaactaccggtaacaaccaccacactattattgaattcaagggtaagtggtacatcttctaccacgctgaatggctcaatgtccaagtctacggaagtcaaaagggttaccgtaccactcacgttgatgaacttccattcttcaatggaaacttccgtaatgctactggtactcttgctggtgttgaacaattatcaaatgttgatgcctacagtaccaactacgcctcaatgatggcttggcaagctggtgtttccgtttatggtttaggtcacaccactgttacctacagaaagggtacctggactggtgtttctggtgttgaatttggtgacaatgccacttccgttaagatttcagctgcctctgccaatggtgctactattagaatcacctctggaagtgaaaacggtgaagttattggttacgttaccgttccagctactggtgatgaattcgtcactgttactgctgatgttagtgtttctggtgttaaggacatcttctttgttgcctctgacgaagttgttgtcgatacctggcaatttgttgctgatgaagctatcagtagtgctgatgaagaaattgaagttgatggtgatgacgaaatcaatgttggtgaagtcgacagtgctgacgaagaaattgacagtgctgatgaagaaatttg

SEQ ID NO: 25221 - DNA, 1434 bp, Piromyces finnis
  GLYCOSYL HYDROLASE 43 FAMILY MEMBER
tccattaattacccacagatacagtgctgatccaggtgttatggtctatgatggtagagtttacgtttacggtactaatgatggtcatgccgatgagttaggtgataatccagaagataacacttaccaacaaattaacactattaatgttatgtcttctgacgatttaattaactgggttgatcacggttccattccagcagccggtgaaaatggtgctgctaagtgggctgtcaactcatgggctccagctgctgctcacaagaagattaatggtaaggaaaagttcttcctttactttgctaacagtggtaatggtattggtgttttaagtagtgattcaccaaccggtccatttaccgatccacttggtggaccaattatttcacgtagtcttccaaactgtaataacattgtttggttatttgatccagctgtttttgttgatgatgatggtacaggttacatttactttggaggaggtgttccagaaggacaatctagcaatccaaagacagtccgtgctgccaagttaagtgatgatatgattagaatttccggtactccacaaaccattgatgctccatgggtctttgaagattcaggtattcacaagtatggcgatacttacttctactcctactgtactaactgggataatggaccatacggtaatgccaagattgcctacatgaccagtaagagtccattaggaccattcacataccaaggtactcttttcaacaacccaggtgaattctttggtactactggtaacaatcaccacactattattgaattcaagggtaagtggtacatcttctaccacgctgaatggctcaatgtccaagtctacggaagtcaaaagggttaccgtaccactcacgttgatgaacttccattcttcaatggaaacttccgtaatgctactggtactcttgctggtgttgaacaattatcaaatgttgatgcctacagtaccaactacgcctcaatgatggcttggcaagctggtgtttccgtttatggtttaggtcacaccactgttacctacagaaagggtacctggactggtgtttctggtgttgaatttggtgacaatgccacttccgttaagatttcagctgcctctgccaatggtgctactattagaatcacctctggaagtgaaaacggtgaagttattggttacgttaccgttccagctactggtgatgaattcgtcactgttactgctgatgttagtgtttctggtgttaaggacatcttctttgttgcctctgacgaagttgttgtcgatacctggcaatttgttgctgatgaagctatcagtagtgctgatgaagaaattgaagttgatggtgatgacgaaatcaatgttggtgaagtcgacagtgctgacgaagaaattgacagtgctgatgaagaaatttg

SEQ ID NO: 25222 - DNA, 900 bp, Piromyces finnis; identical to SEQ ID NO: 25218
  GLYCOSYL HYDROLASE 43 FAMILY MEMBER

SEQ ID NO: 25223 - DNA, 291 bp, Neocallimastix californiae
  Glycosyl hydrolase domain
atacattcgtccaggttacactatcattggttgttacaacaactctgttgcagcttatgatagtgtcggtaagaagcttgtgattgttgccactaatacagctaatactactaagacggttgatttcaacctctctgaattcactagtgttggttacaacattagagtcattagaaccagtggttctgttagtaatggtgaaaagtgggctgaacttaagccactcataccctacggtaaaggtttcaatgctgatttaaagggtaattctattactacttttattgttga

SEQ ID NO: 25224 - DNA, 291 bp, Anaeromyces robustus
  Glycosyl hydrolase domain
atatattcgtccaggttatactattattggtagttataataattcagttgctgcttacgataatgaaggtaaaaaattagttattgtagcaaccaatacagctggttctaataaaattgttgattttgatctttctacctttactagtgttggttataatgttagagttattagaactagtggttcaatgagtaatggtgaacattgggctgaacttacacctcttattccatatggtaaaggtttcaatgctgaattaaaagctaattctattactacttttattgttga

SEQ ID NO: 25225 - DNA, 742 bp, Neocallimastix californiae; identical to SEQ ID NO: 14723
  GLYCOSYL HYDROLASE-RELATED

SEQ ID NO: 25226 - DNA, 1662 bp, Anaeromyces robustus; identical to SEQ ID NO: 14724
  GLYCOSYL HYDROLASE-RELATED

SEQ ID NO: 25227 - DNA, 1099 bp, Neocallimastix californiae
  Glycosyl hydrolases family 6, cellulases
tatttctggaaatccatttagcggagttgaattctacattaatccatactatgttgaagaagttgatggagcaattgctcaaatgtccgattcttcccttattgctaaggctgaaaagatgaagacctactctaatgctatctggttagataccattaagaacatgcaaagttggttagaatctaacttacaaggagctcaatctcaacaccaatctagtggtaaggatgttttaactgttttcgtcgtttacgatttaccaggtcgtgattgtcacgctcttgcttctaatggtgaacttcttgctaacgatggtgattttactcgttacaagtctgaatacattgatgtcattgaaggtcacttaaagacttacaaatctcaaccagttgttcttattgttgaaccagattcacttgctaacatggttaccaatcttgattccactccagcatgtcgtgattctgaaaagtattacatggatggccatgcttacttaattaagaagtttggtgttcttccacatgttgctatgtatcttgatattggtcacgccttctggttaggttgggatgacaaccgtgaaaaggctggtaaggtttatgccaaggttatcagctctggtgctccaggtaaggttcgtggtttcactgataatgttgctaactacactccatgggaagatccaactctttctcgtggaccagaaaccgaatggaacccatgtccagatgaaaagagatacttacaagctattcaaaaggacttcaagtcagctggtattcaatcagtttacttcgtttgtgatacttctcgtaatggtaagaaggttgaccgtaagcacccaggagaatggtgtaaccaaactggagttggtattggagccagaccacaagccagtccagtttctggtatggaataccttgatgctttctactggattaagccacttggtgaatctgatggtacctctgatgaaagtgcagctcgtttcgatggttactgtggtcatgaaaccgctatgaagccagctccagaagccggtcaatggttccaaaagcactttgaacaaggtattaagaatgctaacccaccactc

SEQ ID NO: 25228 - DNA, 1056 bp, Neocallimastix californiae
  Glycosyl hydrolases family 6, cellulases
agaattctatgtcttcccagattatcaaaagcaagttaagagttcttatgataaattaatggctgaaggtgaaactgaaattgctgaacttgtcgctaaagttgctagatatccaactccaacttggttagctaacacagctgcttctaagctcgttccaaaagttttagctcaagttactgaacaaatgaaaaagactggtaagaaggtattaacttctttcattatttacaacttaccaaacagagattgttctgctgttgcctctagaggtgaattaggtattgaacaccttggagtttacaaggaatggattgatgaaattgctggttactttgctgctcacgaaggaccaattgttgctattattgaaccagatgcccttggtaacatggttagtaacagtaacagtgaactctgtgctgaggctttcgaaactcaaatggaagctcttgtctatgctattactaagcttaacttaccaaatgttggtgtttaccaagatgttgcccaagttggttggttaggttggggaggtaacatgaatttacttattccaattcttgaacaactcttaaacaaggtcggtactggtgttttacgtggtttcagttccaacatttctaacaaccaaccattagttagaccagatccaccagaaagaactttaagtggtaactccagtcaaagtgaatacgaatacagtttgaaagttagagaaaacttaaaaaaggttggtatggttgactttggatgggttgttgatacctcacgtaatggtgtaccaaatatcaagaccaaaggtgaaaattggtgtaacattaagggtgccggtattggaagaagaccagaggcttctccagctgatttaccaggacttgatgctgtttactggttcaagccaccaggtgaatctgatggtagtgacagagttggtcaatggggttatgatccaagttgtgctagtgaggattctcttactgactctccaatggctggtcaatggttccacaagcaatttgttgaattagctgttaatgctaatccatccttcaa

SEQ ID NO: 25229 - DNA, 324 bp, Neocallimastix californiae
  Glycosyl hydrolases family 6, cellulases
tcacaatggtaatccatttgctaataaggaattctatattaatccatactatgttaaagaagtcgaaggtgccattgctcaaatgtcagattcttcccttattgctaaggctgaaaagatgaagactttctctaatgctatctggcttgattctatcaaaaacatgcaaagttggttagaatcaaatttgaaaggtgctcttgctcaacaaaatgcttctggtaaagatgttttaactgttttcgtcgtttacgatttaccaggtcgtgattgtcacgctcttgcttctaatggtgaacttcttgctaacgatggtgatttttg

SEQ ID NO: 25230 - DNA, 1096 bp, Neocallimastix californiae
  Glycosyl hydrolases family 6, cellulases
tcacaatggtaatccattctctgatgttgaattcttcattaatccatactatactgctgaagttgatgccgcaattgctcaaatgagtgattcttcccttatcgctaaggctgaaaagatgaagacatactctaatgctatttggttagataccattaagaatatgaatgagtggttagaaaagaatttaaagggagctcttgctcaacaaagtggaagtaagaaggttttaaccgtttttgtggtttacgatttaccaggtcgtgattgtcacgctcttgcttctaatggtgaacttctcgccaatgatggtgatttagctcgttacaagtctgaatacattgatgttattgaaggtcacttaaagacttataaatctcaaccagttgttcttattgttgaacctgattcacttgctaacttagttactaaccttgaatctactccagcttgtgctgactccgaaaaatactatcttgatggtcatgcttacttaattcaaaagtttggtattcttccacatgttgctatgtatcttgatattggtcacgccttctggttaggttgggatgataaccgtgaaaaggcagctaaggtttactctaaggttatcagttccggttccccaggtaaggttcgtggtttcactgataatgttgctaactacactccatgggaagatccaacactttctcgtggaccagacactgaatggaacccatgtccagatgaaaagagatacttagaagccatgcacaaggacttcaaggcagcaggtattagttccgtttacttcgtttgtgatacttctcgtaatggtaagaaggttgaccgtaagcacccaggagaatggtgtaaccaaactggagttggtattggtgccagaccacaagctagtccagtttctggtatggaataccttgatgctttctactggattaagccacttggtgaatctgatggtacctctgatgaatctgcagctcgtttcgatggttactgtggtcatgaaaccgctatgaagccagctccagaagccggtcaatggttccaaaagcactttgaacaaggtattaagaatgctaacccaccactc

SEQ ID NO: 25231 - DNA, 984 bp, Neocallimastix californiae
  Glycosyl hydrolases family 6, cellulases
catttctggtaatccattcaagggtgttgaattctacatcaatccatactatgttgaagaagttgatggagctattgctcaaatgtctgactcttccctcattgctaaggctgaaaagatgaagacttactctaatgctatttggttagatactattaagaatatgcaaagttggttagaatctaacttacaaggagctcaatctcaacaccaaagtagtggtaaagatatcttaacagttttcgttgtttatgatttaccaggtcgtgattgtcacgctcttgcctctaacggtgaacttcttgccaatgatggagatttagctcgttacaagtctgaatatattgatgttattgaaggtcacttaaagacttacaaatctcaaccagttgttcttattgttgaacccgattcacttgctaacttagttactaatcttgaatctactccagcttgtgctgattctgaaaaatactatcttgaaggacatgcttatttaattaagaagcttggtgttcttccacatgttgctatgtatcttgatattggtcacgctttctggttaggttgggatgataatcgtgaaaaggctggtaaagtttatgctaaggttattagttctggtgctccaggtaatgttcgtggtttcactgataatgtttctaactacactccatgggaagatccaactctttctcgtggaccagaaactgaatggaacccatgtccagatgaaaagagatacttagaagctatttctaaggacttcaaatcagcaggtatcaaatccgtttactttgtttctgatagttctcgtaatggtaagaaggttgatcgtaagcacccaggagaatggtgtaaccaaactggtgttggtgttggtgccagaccacaagccagtccaatttctagcatggaataccttgatgctttctactggattaagccacttggtgaatccgatggtacttctgatgactacag

SEQ ID NO: 25232 - DNA, 985 bp, Neocallimastix californiae
  Glycosyl hydrolases family 6, cellulases
cttcagtactggaaacatttacagtaacagtcaataccaaggtgaagttcaatcttctattaataaattaagtggtgaattacaacaacaagctaacagagtaaaatacactccaactgctgtttggttagcttgggatggtgctccaggtgaagttccaaagcatcttggtgctgctggtggtaacactgctgtcttcatgatgtactggatcccaactcgtgattgtaacagtaatgcttcccaaggtggtgcttctgacttaaattcttacaagaattacgttgacagtgtttacaattcattcagatcctatggtaacagtaaaattgttgttgtcgtcgaaccagatactcttggtaacatggtgacttctcaaggtaatgaaaactgtagaagaactgctgttattcataagcaagctcttgcttatgctataaacaaattcggtagtcttaacaatgttcaagtctaccttgatgccggtcacagtcaatggttaaccggttatgaagatgaaactgctgaaattattaaggaaatattagatatggctccacaaggtaagattcgtggtttctccactaatgtatctaacttccaacctgtccaaagagaatatgaatatcatactcgtctttacgatgctcttgaaaaggttggtgtcaagaatatgagattcatcgttgatactagtcgtaatggtgttgatatcagtgaagaatttgcaaagactaagacctggtgtaactttgttggtactggttttggtgaacgtccaaagggtaatccagacccagttaacatgccattattagatgcttatatgtggttaaagccaccagcagaatctgacggttcttctactggtgctcgtgctgatccagtttgtgctcgttctgattctcttccaggggctccagacgctggtcaatggttccatgaatactttgtccaattattaaagaatgctaatccaaaattc

SEQ ID NO: 25233 - DNA, 1099 bp, Neocallimastix californiae
  Glycosyl hydrolases family 6, cellulases
tattaatggtaatccatttgccaatgttgaattctatattaatccatactatgttgaagaagttgacaatgccatttcccaaatgtctgactcttcccttattgctaaggctgaaaagatgaagacttactccaatgctatttggttagataacattaaaaacatgcaaagttggttacaaccaaacttagaaggtgctctctctcaacaaaatagtggtggtaccccagttttaactgtctttgttgtttatgatttaccaggtcgtgattgtcacgctcttgcctccaatggtgaacttcttgccaatgactctgatatggaacgttacaagtcagaatatattgatgttattgaaggtcacttaaagacttacaagtctcaacctgttgttcttgttattgaaccagattcccttgctaacatggtcactaacattgaaagtactccagcttgtgctgattctcaaaattactactttgatggacacgcctacttacttaagaagcttggtgtcttcccaaatgtagccttatatcttgatattggtcacgccttctggttaggttgggatgataaccgtgaaaaggctgcaaaggtctatgctaaggttattcaatctggtgcaccagctaaggttcgtggtttcgttgataacgttgctaactacactccatgggaagacccaactctttcacgtggtccagatactgaatggaacccatgtccagatgaaaagagatacttagaagctatgcacaaggactttactagtgccggtattcaatctgtctacttcttctctgattcctctcgtaacggtaagaagactgaccgtaagcacccaggtgaatggtgtaaccaaaccggttgtggtattggtgccagaccaaaagccagtccaatctctggtatggaataccttgatgccttctactgggttaagccaattggtgaatctgatggtacctcagatactagtgctaagcgttatgatggttactgtggtcacgaaactgccatgaagccagctccagaagccggtcaatggttccaaaagttcttcgaagaaggtcttaagaatgccaatccaccactt

SEQ ID NO: 25234 - DNA, 621 bp, Neocallimastix californiae
  Glycosyl hydrolases family 6, cellulases
catttctggtaatccatttaagggtgttgaattttacattaacccatactatgttgatgaagttgatggagccattgctcaaatgtccgattcttctcttattgctaaggctgaaaagatgaaaacttactctaatgctatttggttagataccattaagaacatgcaaagttggttagaatctaacttaaagggtgctcttgctgaacacaattcaactggaaaggatattttaactgttttcgttgtttacgatttaccaggtcgtgattgtcacgctcttgcttccaatggtgaacttcttgccaactctggtgatatggaacgttacaagtctgaatacattgatgtcattgaaggtcacttaaaggaatataactctcaaccagttgttcttattgttgaaccagattctcttgctaacttagttactaatcttgaatctactccagcttgtcgtgattctgaaaagtattatcttgatggtcatgcttacttaattcaaaagcttggtgttcttccacatgttgctatgtatcttgatattggtcacgccttctggttaggttgggatgataatcgtgaaaaggctggtaaggtttatgccaaggttattcaatt

SEQ ID NO: 25235 - DNA, 883 bp, Neocallimastix californiae
  Glycosyl hydrolases family 6, cellulases
cattaatggtaatccattcaagggtgttgaattttacattaacccatactatgttgatgaagttaatggagccattgctcaaatgtccgattcttctcttattgctaaggctgaaaagatgaagacttactctaatgctatttggttagataccattaagaacatgcaaagttggttagaatctaacttagaaggagctctttctcaacaagaatctactggtaagaaagttttaactgttttcgttgtttacgatttaccaggtcgtgattgtcatgctcttgcttccaatggtgaacttcttgccaactctggtgatatggaacgttacaagaccgaatacattgatgtcattgaaggtcacttaaagaaatacaagtctcaaccagttgttcttattgttgaaccagattctcttgctaacatggttactaatattgaaactactccagcttgtgctgattcacaaaactattactatgatggtcatgcctacttacttaagaagtttggagttcttccacatgttgctatgtatcttgatattggtcacgccttctggttaggttgggatgataatcgtgaaaaggctggtaaggtttatgccaaggttattcaatcaggttcaccaggtaaggttcgtggtttcaccgataatgtttcaaactacactccatgggaagatccaactctttctcgtggaccagaaactgaatggaatccatgtccagatgaaaagagatatttagaagctatgcacaaggacttcaaggcggcaggtattgaatcagtttactttgtttccgatacttctcgtaatggacacaagactgaccgtaagcacccaggagaatggtgtaaccaaacaggagttggtattgga

SEQ ID NO: 25236 - DNA, 118 bp, Neocallimastix californiae
  Glycosyl hydrolases family 6, cellulases
cattaatggtaatccattcaagggtgttgaattttacattaacccatactatgttgatgaagttaatggagccattgctcaaatgtccgattcttctcttattgctaaggctgaaaag

SEQ ID NO: 25237 - DNA, 444 bp, Neocallimastix californiae
  Glycosyl hydrolases family 6, cellulases
catttctggtaatccattcaagggtgttgaattctacatcaatccatactatgttgaagaagttgatggagctattgctcaaatgtctgactcttcccttattgctaaggctgaaaagatgaagacttactctaatgctatttggttagataccattaagaacatgcaaagttggttagaatctaatttacaaggagctcaatctcaacaccaaagtagtggtaaggatatcttaactgttttcgttgtttacgatttaccaggtcgtgattgtcacgctcttgcttctaacggtgaacttcttgccaatgatggagatttagctcgttacaagtctgaatacattgatgttattgaaggtcacttaaagacttacaaatctcaaccagttgttcttattgttgaacccgattcacttgctaacttagttacaaatcttgaatc

SEQ ID NO: 25238 - DNA, 955 bp, Neocallimastix californiae
  Glycosyl hydrolases family 6, cellulases
tgaaaatttctttgataacgaactttatattagcccaaactatgttaaagaaattgaatcaactattccagatttgagtccagaattacaagcaaaagccaagaatgttgaaaaggtttcttctgctgtttggttagcctatgaaggtgctccaaatgatgttgctccacatcttaaagctgctggttcaaagactgttactttcattctttatatgattccaactcgtgattgtaatagtttagcttctgctggtggtgtttctgatcttgacaagtacaagggttatgttgacaagattgctaacactattaagaaattcccagaatctaaggttgttatggttattgaaccagatactcttggtaatcttattacaggtgaaactgaagcttgtaagaatgttcacactttacataagcaagctttagcttatgccgctaatgttttcggtaacatgagtaatgttagtgcttatcttgatgctgctcatagtaaatggttaggatgggctgctgataaggttgccgctgttgttaaggaaattttagacaatgctccaaatgctaatattcgtggttttagtactaatgtttctaattacatgccaattgaagctgaatatgaatatcatcaaaaactccatgatgctcttgaagaagtcggtattaaggacaaaagattcattgttgatactggtcgtagtggtgttgatgtacgtgaagaattcgatgttaaccaaacctggtgtaatttaatttatgctggtttaggtgaaccatcacgtggaagtccagatccagaaaatatgccattattagatgctttcatgtggctcaaaccaccaggtgaagctgatggttctgacactggttctagagctgatccagtttgtggacgtgaagattcattcccaggttctccagatgctggttcatggttcggagaatacttt

SEQ ID NO: 25239 - DNA, 295 bp, Neocallimastix californiae
  Glycosyl hydrolases family 6, cellulases
catttctggtaatccattcaagggtgttgaattctacatcaatccatactatgttgaagaagttgatggagctattgctcaaatgtctgattcttccctcattgctaaggctgaaaagatgaagacttactctaatgctatttggttagatactattaagaatatgcaaagttggttagaatctaacttacaaggagctcaatctcaacaccaaagtagtggtaaggatatcttaacagttttcgttgtttatgatttaccaggtcgtgattgtcacgctcttgcctctaacggt

SEQ ID NO: 25240 - DNA, 126 bp, Neocallimastix californiae
  Glycosyl hydrolases family 6, cellulases
cattaatggtaatccattcaagggtgttgaattttacattaacccatactatgttgatgaagttaatggagccattgctcaaatgtccgattcttctcttattgctaaggctgaaaagatgaagac

SEQ ID NO: 25241 - DNA, 1099 bp, Neocallimastix californiae
  Glycosyl hydrolases family 6, cellulases
cattgaaggtaatccatttgctaatgtcgaattttacattaatccatactatgttgaagaagttgataatgccatctcccaaatgtctgactcttcccttattgctaaggccgaaaagatgaagacctactctaatgctatttggttagataatattaagaatatgcaaagttggttagaaccaaacttaaagggtgctctctctcaacaaaacagtggtggtactccagttttaactgtctttgtcgtttacgatttaccaggtcgtgattgtcacgctcttgcctccaatggtgaacttcttgccaatgactctgatatggaacgttataagtcagaatacattgatgtcattgaaggccacttaaagacttacaagtctcaacccgttgttcttgttattgaaccagattcccttgctaatatggttactaacattgaaagtactccagcttgtgctgattctcaaacttactattatgatggacacgcctacttacttaagaagcttggtgtcttccccaatgtagccttatatcttgatattggtcatgccttctggttaggttgggatgataaccgtgaaaaggctgcaaaggtttattctaaggttattcaatctggttctccagcaaaggttcgtggtttcgttgataatgttgctaactacactccatgggaagacccaactctttcacgtggtccagatactgaatggaacccatgtccagatgaaaagagatacttggaggctatgcacaaggacttcaaggcagctggtattcaatctgtctacttcttctctgattcatctcgtaacggtaagaagactgaccgtaaacacccaggtgaatggtgtaaccaaactggttgtggtgtcggtgcaagaccaaaagcaagtccaatctctggtatggaataccttgatgccttctattgggttaagccaatcggtgaatctgatggtacctctgatactagtgctaaacgttatgatggttactgtggtcacgaaactgccatgaaaccagctccagaagccggtcaatggttccaaaaattcttcgaagaaggtatcaagaacgccaatccaccactt

SEQ ID NO: 25242 - DNA, 259 bp, Neocallimastix californiae
  Glycosyl hydrolases family 6, cellulases
tcacaatggtaatccattcgcaaataaggatttctatattaatccatactatgtcgaagaaattgaaggtgctattgctcaaatgtctgattcttcccttattgctaaggctgaaaagatgaagacttactctaatgccatctggcttgattccatcaaaaatatgcaaagttggttagaaactaatttgaagggtgctctttctcaacaaaatgcttctggtaaagatgttttaaccgttttcgttgtttacgattta

SEQ ID NO: 25243 - DNA, 1078 bp, Neocallimastix californiae
  Glycosyl hydrolases family 6, cellulases
tggcaatccatttaaagacgctgaattctacattaatccatattatactactgaagttgatgctgccattactaaaataagtaacgcttctcttattgctaaggctgaaaaaatgaaggaattctcaaatgccatttggttagattctattaaaaatatgaacgaattgcttgaaagcagtttaaatggtgctcttgctcaacaagaaagtggatataagaaagttttaaccgtttttgttgtttacaatttaccaggtcgtgattgtcatgctcttgcttctaatggtgaacttcttgccaatgatgctgactttgatcgttacaagtctgaatacattgatgttattgaaggtcacttaaagacttacaaatctcaaccagttgttcttattgttgaaccaaattcacttacaaacttagtgactaaccttgaatctactccagcttgttctgattccgaaaaatactatcgtgaaggaaatgcttacttaattaagaagtttggagttttaccacacgttgctctatatcttgatattggtcatgcctatttattaggttgggatgatactcgtgaaaaagctgctagactttaccatgatgttattagatcaggtgctccaggtaatattcgtggttttgctgataatattggtggcttcgttccatgggatgatccaaatctttctaatggaccagaaactgaatggaatccatgtccagatgagaagagatacttaaaagctatgtacagcgatttcgtgtctgcaggtattcatagcgttaaattcgttactgatacttcacataatggtaagaagtttgattatagtgatagggaattatggtgtaaatcaacatctgctggtgttggtgctagaccaatggctattccaattactactatagattatcttgatgctttctattggattaagccatttggtaacgtatctgaattaccaaatcaaagtagctttgataatgtttgtaaagatggtttagaaatatattcaagcgatacctggagtcaaaaggtctttgaagaaggtattaggaatgctaatccaccactc

SEQ ID NO: 25244 - DNA, 1053 bp, Neocallimastix californiae
  Glycosyl hydrolases family 6, cellulases
tttcttcgttttcccagactatcaaaagcaagttaagagttcatacgataaattaatagctgaaggtgaaacagaagttgcagaaattgttgccaaggttgctagatacccaactccaacttggttagccaacacagcggcttccaaactcgttccaaaggttttagcccaagttactgaacaaatgaaacagactggtaagaagattttaacttctttcattatttacaatttaccaaacagagattgttctgctgttgcctcaagaggtgaattaggtacagaacatcttggtgtctataaagaatggattgatgaaattgcaggttattttgccgctcatgaaggaccaattgttgcaattattgaaccagatgcccttggtaatatggttggtaatagtaacagtgaactttgtgctgaagcttttgaaactcaaatggaagctcttgtctatgccattacaaaacttaacttaccaaatgttagtgtttaccaagatgttgcccaagttggttggttaggttggggtggtaacatgagattacttattccaattcttgaacaactcttaaacaaagtcggtactggtgttttacgtggtttcagttctaacatttctaataatcaaccattaacaaaaccagatccaccagaaaaaactttaagtggctgcacaagtcaaagtgaatatgaatacagtttgaatgttagagaagccttaagaaaagttggtatggtagactttggatgggttgttgatacctctcgtaatggtgttccaaatattaagactaagggtgaaaattggtgtaatattaagggtgctggtattggtagaagaccagaagctacaccagaagatttacctggtcttgatgctgtttactggttcaaaccaccaggtgaatctgatggtagtgacagagaaggacaatttggttatgatccaatgtgtgctagtgaagattctcttacggattctccaagagctggtcagtggttccacaagcaatttgttgaattagctgtaaatgctaacccatccttcaa

SEQ ID NO: 25245 - DNA, 994 bp, Neocallimastix californiae
  Glycosyl hydrolases family 6, cellulases
aattggtgacaacttctttgaaaatgaactttacagtaacttcaaattccaaggtgaagttgattcttccattaaaaagttaagtggtaatgttaagcaaaaggccgaaaaggtaaaatatgttccaacggctgcttggttagcttgggaaggtgcccccaatgaagttccacaataccttgatgaagctggctcaaagaccgtggtcttcgtcttatatatgattccaactcgtgattgtaatgctaatgcctctgctggtggtacagccaatattgataagtacaagtcctacgtggataagatttacaacaccattaacaaatatccaaactctagaattgttatgattcttgaaccagatactattggtaaccttgtcactgctaacaatgccaactgtagaaatgtccaaaatatgcataagcaagctctctcctacgccatcagtaaatttggtactcaaagtaatgtaagagtctatcttgatgccgctcacggtgcctggttaaacccacacgcggataagaccgctcaagtaattaaggaaatcttaaacaatgctggtaatggaaaacttcgtggtatcagtaccaatgtttctaactaccaaagcgttgccagcgaatacaaataccatcaaaaccttaacagagctcttgaaaaccttggtgtcagaggcttaaagtttattgttgatacctctcgtaacggtgctaacgttgaaggtgccttcaatgcctccggtacctggtgtaacttcaagggtgccggtttaggtgaacgtccaaagggtaatccaaacccaggtagtatgccattacttgatgcctacatgtggattaagactccaggagaagctgatggttcctctcaaggttctagagctgatccagtttgtgctcgtggtgattctcttcaaggtgctccagatgctggttcatggttccatgattactttgtcatgttgattaacaatgccaacccacctttc

SEQ ID NO: 25246 - DNA, 982 bp, Neocallimastix californiae
  Glycosyl hydrolases family 6, cellulases
cagttccggaaatatttacagtaatagtcaataccaaagtgaagttcaatcatctattaacaaattaagtggtgaattacagcaacaagcttctagagtaaaatacaccccaaccgctgtttggttagcttggtatggtgctccaaatgaagttccaaaacatcttggggctgctggtggtaacactgctgtcttcataatgtactggattccaactcgtgattgtaacagtaatgcctctcaaggtggtgctagcgacttaaattcttacaagaattatgtcgatagtgtttataacaccttcagatctaacggtaacagtagaatcgttattgttattgaaccagatactattggtaacatagtgacttctcaagggaatgaaaattgtagaagaactgctattattcataaggaagcccttgcatatgccgttaacaaatttggtagtcttaacaatgttcaagtttatcttgatgccggtcacagccaatggttaaccggttatgaagatgaaactgctgctattattaaagaaattttagatatggcaccacaaggtaagattcgtggattctccactaatatttctaacttccaacccgttcaaagagaatatgaatatcatactcgtctttatgatgctcttgaaaaggttggtatcagcaatatgagatttattgttgatactagtcgtaatggggttgatatcagtgaagcctttgctaagactaagacctggtgtaactttgttggtactggttttggtgaacgtccaaagggtaatccagatcctataaatatgccattattagatgcttacatgtggttaaagccaccagcagaatctgatggttcttctcaaggtatgcgtgctgatccagtctgtgctcgtcctgattctcttccaggagctccagaagctggtcaatggttccacgattattttgttcaattattaagaaatgcaaatccaaaattc

SEQ ID NO: 25247 - DNA, 1099 bp, Neocallimastix californiae
  Glycosyl hydrolases family 6, cellulases
cctcaacggtaatccattcgccaataaaatcttctacattaatccttattatgttgaagaagttgatggtgccattgctcaaatgattgatgcttctcttatttcaaaggctgaaaaaatgaagactttctcaaatgctatttggcttgatactatcaaaaatatgcaaagttggttagaacctaatttaaagggagcccttgctcaacaaaagtctgccggaaaggaagttttaacggttttcgttgtttacgatttaccaggtcgtgattgtcatgctcttgcttccaatggtgaacttcttgctaataaaggagattgggctcgttacaagtccgaatatattgatgtcattgaagaaaagttaagaacttacaaatctcaacccgtcgttcttattgttgaaccagattcattggctaacatggtcactaatcttgattctactccagcttgtcgtgattctgaaagatattacatggatggccatgcctacttaattcaaaaattcggtgttcttccacatgttgctatgtatcttgatattggtcatgccttctggttaggatgggatgataatcgtcaaaaggccggaaaggtctattccaaggtgattcaatctggagcaccaggtaaagttcgtggtttcacggataatgtggctaactacactccatgggaagatccaaccctttctcgtggaccagaaaccgaatggaatccatgtccagatgaaaagagatacttagaagctattcacaaggacttcacggctgtaggcattccatcggtttactttgtttgtgatacttctcgtaatggtaaaaaggttgatcgtaagcatccaggagaatggtgtaaccaaactggagttggtattggtgccagaccacaagccagtccaatttccggtatgccataccttgatgccttttattggattaagccacttggtgaatctgatggtacctctgataccagtgctgctcgtttcgatggttactgtggacatgaaactgccatgaagccagccccagaagccggtcaatggttccaaaagcactttgaacaaggtcttaaaaatgctaatccaccactc

SEQ ID NO: 25248 - DNA, 1096 bp, Neocallimastix californiae
  Glycosyl hydrolases family 6, cellulases
taacccattcgctggtcacaagttctacgttaatccatactacgttgataaagttgacaaggccattgctcaaatgcacgactacgacagttcacttaaatttaaggccgaaaagatgaaggaatactctaacgctatttggttagataccattaataacatggaagcctggttagaaagaaaccttaagggtgctcttgctcaacaaaatgccgaaggtagtagagttttaactgtcttcgtcgtttacgatttaccaggccgtgactgtcaggctcttgcctccaacggtgaacttctcgccaacaatggtgatatgaaacgttacaaatctgaatacattgatatcattgatagacgcttatctacttacaagtctcaaccaattgttcttgttattgaaccaaattcccttgctaacttagttactaaccttgaaaacattccagcttgtgctgactctgaaaaatactacttagatggtcacgcttacttaattaagaagttcggttcccacccacacgttgccatgtacctcgatattggtcacgctttctggttaggttgggatgataaacgtgctagtgccgctaagatttactctaaagttattaaccctggtgctccaggtaaagttcgtggtttcgcttccaacgtcgctaactacactccatgggaagacccagaactttctcgtggcccagacactgaatggaacccttgcccagatgaaaagagatacatcaaagccatgtacaaggaattcaaggctgccggtatctcctctgtttacttcattgaagatacttctcgtaatggtcacaagacttaccgtaaccactcaggtgaatggtgtaaccaaatgggatctggtattggtgccagaccaaaggcttatccagtttccggtatggaatatctagatgctttctactgggttaaaccatacggtgaatctgatggtacttctgatgaatctgataagagttttgatggttactgtggtcacgcaaccgccatgaagccagctccagaagccggtcaatggttccaaaaattcttcgaagaaggtcttatgaatgctaacccaccactt

SEQ ID NO: 25249 - DNA, 1096 bp, Neocallimastix californiae
  Glycosyl hydrolases family 6, cellulases
gatcaatggtaacccattcaagggtgttgatttctaccttaacccatactacgttgaagaagttgaaaatgctcttaacaatcttattgattcttctcttagatcaaaggttgaaaagatgaagactttctctaatgctatctggcttgataccattaataacatgcaaagttggttagaaccaaaccttaagggtgctcttgctcaacaccaatctactggtaaggatgtcttaactgtctttgttgtttacgatttaccaggtcgtgattgtcacgctcttgcttccaatggtgaacttcttgctaacgatgctgatgctcaacgttacaagaccgaatacattgatgttattgaatctcacttaaagcaatacactgctcaaccagttgttcttattattgaaccagattcacttgctaacatggttactaaccttgatgatccacactgttctcaatctgaatcctactatatggatggtcatgcttacttacttaagaagtttggtgttcttgaccacgttgctatgtaccttgatattggtcacgctttctggttaggttgggatgataaccgtgaaaaggctgctaagctttacaagaaggttattgactctgcttctccaggtaaggttcgtggtttcgttgataatgttgctaactacactccatgggaagacccaactctttctcgtggtccagatactgactggaacccatgtccagatgaaaagagatacttagaagctgttaagaaggactttacttctgctggtattaagtctgtttacttcgtcagtgatacttctcgtaatggtcacaagaccgaccgtaagcacccaggtgaatggtgtaaccaaactggtgttggtgttggtgctcgtccacaagctagtccagtttctggtatggattaccttgatgctttctactggattaagccacttggtgaatctgatggtacctctgatgaatctgctgttcgtttcgatggttactgtggtcacgataccgctatgaaaccagctccagaagccggtcaatggttccaagctcacttcgaacaaggtgttgaaaacgctaacccaccactc

SEQ ID NO: 25250 - DNA, 1099 bp, Neocallimastix californiae
  Glycosyl hydrolases family 6, cellulases
gatcagtggtaacccattcaagggtgttgatttctaccttaacccatactacgttgaagaagttgaaaatgctattaagcaaatgactagctcttctcttaaggctaaggctgaaaagatgaagacttactctaacgccatctggcttgataacattaagaacatgcaaagttggttagaaccaaaccttaagggtgctcttgctcaacaccaatctactggtaaggatgtcttaactgtctttgttgtttacgatttaccaggtcgtgattgtcacgctatggcttccaatggtgaacttcttgctaacgattctgatgctcaacgttacaagactgaatacattgatgttattgaaagtcacttaaagaaatacactgctcaaccagttgttcttattattgaaccagattcacttgctaacatggttactaacattgaaaacactccagcttgtgctgaatctgaaacttactactacgatggtcacgcttacttacttaagaagtttggtgttcttgaccacgttgctatgtaccttgatattggtcacgctttctggttaggttgggatgataaccgtgaaaaggctactaaggtttacaagaaggttattgactctggttctccaggtaaggttcgtggtttcgttgataacgttgctaactacactccatgggaagacccaactctttctcgtggtccagatactgaatggaacccatgtccagatgaaaagagatacttagaagctatgtacaaggactttacttctgctggtattaagtctgtttacttcgtcagtgactcttctcgtaatggtcacaagactgaccgtaagcacccaggtgaatggtgtaaccaaactggtgttggtattggtgctcgtccacaagctagtccaatctctggtatggattaccttgatgctttctactggattaagccacttggtgaatctgatggtacctctgacgaatctgctgatcgtttcgatggttactgtggtcacgataccgctatgaaaccagctccagaagccggtcaatggttccaaaagcacttcgaacaaggtcttgaaaacgctaacccaccactt

SEQ ID NO: 25251 - DNA, 1099 bp, Neocallimastix californiae
  Glycosyl hydrolases family 6, cellulases
gatcagtggtaacccattctctggagttgaattctaccttaacccatactacgttgaagaagttgaaaatgctattaagcaaatgactagctcttctcttaaggctaaggctgaaaagatgaagacttactctaacgccatctggcttgataacattaagaacatgcaaagttggttagaaccaaatcttaagggtgcactttcacaacaccaatctactggtaaggatgtcttaactgtctttgttgtttacgatttaccaggtcgtgattgtcacgctcttgcttccaatggtgaacttcttgctaacgattctgatgctcaacgttacaagactgaatacattgatgttattgaaaaacaattaaagcaatacactgctcaaccagttgttcttattattgaaccagattcacttgctaacatggttactaacattgaaaccactccagcttgtgctgaatctcaagattactacttcgatggtcacgcttacttacttaagaagttcggtgttcttgaccacgttgctatgtaccttgatattggtcacgctttctggttaggttgggatgataaccgtgaaaaggcctctaaggtttacaagaaggttattgactctggttctccaggtaaggttcgtggtttcgttgataacgttgctaactacactccatgggaagacccaactctttctcgtggtccagaaactgaatggaacccatgtccagatgaaaagagatacttacaagctatgtacaaggactttaccgctgctggtattaagtctgtttacttcgtcagtgactcttctcgtaatggtcacaagactgaccgtaagcacccaggtgaatggtgtaaccaaactggtgttggtattggtgctcgtccacaagctagtccaatctctggtatgagttaccttgatgctttctactggattaagccacttggtgaatctgatggtacctctgatgaatctgctgctcgtttcgatggttactgtggtcacgataccgctatgaaaccagctccagaagccggtcaatggttccaaaagcacttcgaacaaggtcttgaaaatgctaacccaccactc

SEQ ID NO: 25252 - DNA, 1084 bp, Neocallimastix californiae
  Glycosyl hydrolases family 6, cellulases
tcataatggtaatccattcaaggatgttgaatttttcattaatccatattacactgctgaagttgatgctgccatcgctcaaatgtccgattcttctcttatttctaaagctgaaaaaatgaaaactttttcaaatgctatttggttagatactattaaaaatatgaatgaatggttagaaaagaatttaaagggagctcttgctcaacaaactggaaataaaaaagttttaaccgttttcgttgtttatgatttaccaggtcgtgattgtcatgctcttgcttctaatggtgaactcctcgctaatgattcagattgggctcgttacaaaactgaatatattgatgtcattgaagaaaaattgaaaacttacaaatctcaacctgttgttcttattattgaaccagattcacttgctaatttagttaccaatctcgactctactcctgcttgtcgtgattccgaaaagtattatctcgatggacatgcctacttaattcaaaagtttggtgttcttaaacatgttgctatgtatcttgatattggacatgctttctggttaggttgggatgataatcgtgaaaaggctgctaaagtttattcaaaggttatcagttccggagcaccaggtgaagttcgtggtttcactgataatgttgctaattatactccatgggaagatccaactctttctcgtggtccagatactgaatggaatccatgtccagatgaaaagagatatttagaagctattcataaagatttcgtttcagctggaattaaatcagtttacttcgttagtgatacttcacgtaatggtaagaaggttgatcgtaaacatccaggagaatggtgtaaccaaacaggagttggtgttggtgctagaccacaagctaatccagtttcaggaatggattatcttgatgcattctattggattaaaccacttggagaatcagatggtacatcagatgaaagtgcagctcgtttcgatggttattgtggacatgaaacagccatgaaaccagcaccagaagctggtcaatggttccaaaagcactttgaacaaggtattaagaatgcc

SEQ ID NO: 25253 - DNA, 1096 bp, Neocallimastix californiae
  Glycosyl hydrolases family 6, cellulases
tcataatggtaatccattcaaggatgttgaatttttcattaatccatattacactgctgaagttgatgctgccatcgctcaaatgtccgattcttctcttatttctaaagctgaaaaaatgaaaactttttcaaatgctatttggttagatactattaaaaatatgaatgaatggttagaaaagaatttaaagggagctcttgctcaacaaactggaaataaaaaagttttaaccgttttcgttgtttatgatttaccaggtcgtgattgtcatgctcttgcttctaatggtgaactcctcgctaatgattcagattgggctcgttacaaaactgaatatattgatgtcattgaagaaaaattgaaaacttacaaatctcaacctgttgttcttattattgaaccagattcacttgctaatttagttaccaatctcgactctactcctgcttgtcgtgattccgaaaagtattatctcgatggacatgcctacttaattcaaaagtttggtgttcttaaacatgttgctatgtatcttgatattggacatgctttctggttaggttgggatgataatcgtgaaaaggctgctaaagtttattcaaaggttatcagttccggagcaccaggtgaagttcgtggtttcactgataatgttgctaattatactccatgggaagatccaactctttctcgtggtccagatactgaatggaatccatgtccagatgaaaagagatatttagaagctattcataaagatttcgtttcagctggaattaaatcagtttacttcgttagtgatacttcacgtaatggtaagaaggttgatcgtaaacatccaggagaatggtgtaaccaaacaggagttggtgttggtgctagaccacaagctaatccagtttcaggaatggattatcttgatgcattctattggattaaaccacttggagaatcagatggtacctcagatgaaagtgcagctcgtttcgatggttattgtggacatgaaacagccatgaaaccagcaccagaagctggtcaatggttccaaaagcactttgaacaaggtattaagaatgccaatcctccactt

SEQ ID NO: 25254 - DNA, 1099 bp, Neocallimastix californiae
  Glycosyl hydrolases family 6, cellulases
tcacaatggtaatccatttgctaataagattttctatattaacccatactatgttgaagaagtggatggtgctatcgctcaaatgtctgattcttccttgatttctaaggctgaaaagatgaagacttactccaatgctatctggcttgattccatcaaaaatatgcaaagttggttggaatcaaatttaaaaggtgctctctcccaacaaaatgcctctggtcaagatgttttaactgttttcgttgtctacgatttaccaggtcgtgattgtcatgctcttgcttctaatggtgaacttcttgccaatgatagtgattgggctcgttataagactgaatatattgatgtcattgaaggtcacttaaagacttacaaatctcaaccagttgttcttattattgaaccagattcacttgcaaatatggttactaatcttgattctactccagcttgtcgtgattccgaaaagtattacatggatggtcatgcttatttaattcaaaagtttggtgttcttcctcacgttgctatgtatcttgatattggtcacgccttctggttaggttgggatgataatcgtcaaaaagctggtaaggtctactccaaagttatcagctctggtgctccaggtaaggttcgtggattcactgataatgttgctaactacactccatgggaagatccaactctttctcgtggaccagaaactgaatggaatccatgcccagatgaaaagagatatttagaagctatgtataaagactttaaggccgctggtattgaatccgtttacttcgtttgtgactcttctcgtaatggtaagaaagttgatcgtaaacacccaggtgaatggtgtaaccaaactggtgctggtgttggttatagaccacaagccaatccaatttcaggtatgagttatcttgatgctttctactggattaagccacttggtgaatccgatggtacttctgatgaaagtgcagctcgtttcgatggctactgtggacatgaaactgccatgaaaccagctccagaagccggtcaatggttccaaaagttctttgaggaaggtcttaagaatgctaatccagctctt

SEQ ID NO: 25255 - DNA, 982 bp, Neocallimastix californiae
  Glycosyl hydrolases family 6, cellulases
tagtgataacttctttgaaaatgaactttacagtaacttcaagttccaaggtgaagttgatacatctattgctaaattaagtggtcaattacaagaaaaggctaaaaaggttaagtacgttccaactgctgcttggttagcttgggaaggtgccactaatgaagttccacaataccttaatgaagctggtgacaagactgttgtctttgtcttatatatgattccaactcgtgattgtaacgctaatgcttctgttggtggatctggtagtttagacaagtacaagggttatgtcgacaacatttacaacactattaacagatatccaaattcaagaattgttatgattcttgaaccagatactattggtaatcttgttactgctaacaatgataattgtagaaacgttcaaaacatgcacaaacaagctctttcttacgccattagtaaattcggtactcaaagtaatgttagagtttatcttgatgctgctcacggtgcttggttaaattcacacgccgatagaactgctcaagttattgctgaaatcttacgtaatgctggtaatggtaagattcgtggtattagtactaacatttctaactaccaacaagttagtgatgaataccaatatcaccaaaaccttaacagagctcttgaaagccaaggtttcagaggtatgaaattcattgttgatacttctcgtaatggtcaaaatgttactgctgccttctctagaaacaacacctggtgtaacttcaagggtgctggtttaggtccacgtccacaagccaatccaaatccaaacatgcctttacttgatgcttacatgtggattaaaactccaggtgaagctgatggttctgctactggttctagagctgatccagtttgtgctagacaagattctcttcaaggtgctccagatgctggttcatggttccacgattactttgttatgttattacaaaacgctaaccca

SEQ ID NO: 25256 - DNA, 921 bp, Neocallimastix californiae
  Glycosyl hydrolases family 6, cellulases
cttcttcgaaaatgaactttacattaaccaagattacgttaaaaagattgaatctactttaaaggatatgactccagaattacaagctaaggctaagaatgttgaaaaggttgcaactgctgtttggttagcttgggaaggtgctccaggtgaagttgaaccacaccttaaggctgctggtaacaagactattacctttattctttacatgattccaactcgtgactgtaatagtttagcttcagctggtggtgctgctgattttgaaaaataccaaggttatgttgacagtattgctgctactattaagaaatacccagatgctaaggttaacatggttattgaaccagatactcttggtaaccttattactggtgaaactgaagcttgtaagaaggttcatgacttacacagaaaagctttatcttacgccgttaacgttttcggtaacatgagtaatgttaatgcttatcttgatgctgcccaccacaaatggttaggttggggaacagacaaggttgctgctctcattaaggacattttagataatgctccagatggtgatattcgtggtattagtactaatgtttctaactaccaatccattgataatgaataccaataccacactgaccttcacgctgctcttgaagctgtcggtattactggaaagaaattcattgttgataccggtcgtagtggtgttgatgttactgaagaattcaatgttaaccaaacctggtgtaaccttatctacgctggtttaggtgaaaaatctcgtggtaacccagatccagaaaagtacccattattagatgccttcatgtggcttaaaccaccagcagaatctgatggttctgatgttggtagcagagctgatccagtttgtgctcgtgaagattcattcccaggtgctccaga

SEQ ID NO: 25257 - DNA, 1059 bp, Neocallimastix californiae
  Glycosyl hydrolases family 6, cellulases
tgatgacttctacgttttcccagattatcaaaaacaagttaagagttcatacgatcaattaattgctgaaggtcaaaacgatgttgctgaaattgttgctaaagttgctagatatccaactccaacttggttagctaatactcaagcttccaaacttgttccaaaggtcttagctcaagttactgaacaaatgaaggctaccggcaaaaagattttaactgctttcattatttataatttaccaaacagagattgttctgctgttgcttcaagaggtgaattaggtattgaacatcttggtgtttacaaggaatggattgatgaaattgcaggttattttaaagctcacgaaggaccaatcgttgctattattgaaccagatgcccttggtaatatggttagtaacagtaatagtgaactttgtgctgaagctttcgatactcaaatggaagctattgtttatgctattaataaacttagcttaccaaatgttagtgtttaccaagatgtagctcaagttggttggttaggttggactggtaacatgaatattcttgttccaattcttgaacaaatcttaaacaaggttggtacaggtaaattacgtggtttcagttctaacatttctaataatcaaccattagttaaaccagatccaccagaagctactttaagtggtaacaagagtcaaagtgaatatgaatacagtttgaatgttagagaagccttaagaaaggttggtattgccgatatgggttgggttgttgatacttctcgtaatggtagaactaacattaagactagaggtgaaaactggtgtaatattaagggtgctggtattggtagaagaccagaagctaatccagctgatttaccagaacttgatgctgtttactggtttaagccaccaggtgaatctgatggtagtgacagaaagggacaatggggttatgatccatcttgtgctagtgaagattctcttactgattctccaatggccggtcaatggttccataaacaatttgttgaattagctgttaatgctgttccatcattcga

SEQ ID NO: 25258 - DNA, 471 bp, Neocallimastix californiae
  Glycosyl hydrolases family 6, cellulases
taacccattcgctggtcacaagttctacattaatccatactacgttgacgaagttgacaaggccattgctcaaatgaacggttcacttagaattaaggccgaaaagttgaaggaatactctaacgctatttggttagataccatccataaaatggaagtacgattagaaagaaaccttaggggtgctcttgctcaacaaaatgccgaaggtagtagagttttaactgtcttcgtcgtttacgatttaccaggtcgtgactgtcaggctcttgcctccaacggtgaacttctcgccaacgatggtgatatgaaacgttacaagactgaatacattgatatcattgatagtgtcttaattagttaccattctcaaccaattgttcttgttattgaaccaaattcccttgctaacttagttactaaccttgaaaacattccagcttgtgctgactctgaaaaatactacttaga

SEQ ID NO: 25259 - DNA, 343 bp, Anaeromyces robustus
  Glycosyl hydrolases family 6, cellulases
gatcagtggtaacccattctctggagttgaattctaccttaacccatactacgttgaagaagttgaaaatgctattaagcaaatgactagctcttctcttaaggctaaggctgaaaagatgaagacttactctaacgccatctggcttgataacattaagaacatgcaaagttggttagaaccaaatcttaagggtgcactttcacaacaccaatctactggtaaggatgtcttaactgtctttgttgtttacgatttaccaggtcgtgattgtcacgctcttgcttccaatggtgaacttcttgctaacgattctgatgctcaacgttacaagactgaatac

SEQ ID NO: 25260 - DNA, 1099 bp, Anaeromyces robustus
  Glycosyl hydrolases family 6, cellulases
acacaatggtaacccattcaaaggtgttgaattcttcattaacccatactatgttgatgaagttgataaggctattgctcaaatgaccaactcatctcttaaggctaaggctgaaaagatgaagactttctctaacgctatttggctcgataccattaagaacatgaatgaatggttagaaagaaaccttaagggagctcttgctcaacaaaacgcttctaacaagaatgttttaactgttttcgttgtttacgatttaccaggtcgtgattgtcacgctcttgcttctaatggtgaacttcttgctaatgattctgactttgctcgttacaagtctgaatatattgatgttattgaaactcacttaaagaaatacactgctcaaccagttgttcttattattgaaccagattcacttgctaacatggttactaacattgaaaacactccagcttgtgctgaatctgaaacttactactacgatggtcacgcttacttacttaagaagtttggtgttcttgaccacgttgctatgtaccttgatattggtcacgctttctggttaggttgggatgataaccgtgaaaaggctactaaggtttacaagaaggttattgactctggttctccaggtaaggttcgtggtttcgttgataacgttgctaactacactccatgggaagacccaactctttctcgtggtccagatactgaatggaacccatgtccagatgaaaagagatacttagaagctatgtacaaggactttacttctgctggtattaagtctgtttacttcgtcagtgactcttctcgtaatggtcacaagactgaccgtaagcacccaggtgaatggtgtaaccaaactggtgttggtattggtgctcgtccacaagctagtccaatctctggtatgagttaccttgatgctttctactggattaagccacttggtgaatctgatggtacctctgatgaatctgctgctcgtttcgatggttactgtggtcacgataccgctatgaaaccagctccagaagccggtcaatggttccaaaagcacttcgaacaaggtcttgaaaatgctaacccaccactc

SEQ ID NO: 25261 - DNA, 949 bp, Anaeromyces robustus
  Glycosyl hydrolases family 6, cellulases
tagtgataacttctttgaaaatgaactttacagtaacttcaagttccaaggtgaagttgatacatctattgctaaattaagtggtcaattacaagaaaaggctaaaaaggttaagtacgttccaactgctgcttggttagcttgggaaggtgccactaatgaagttccacaataccttaatgaagctggtgacaagactgttgtctttgtcttatatatgattccaactcgtgattgtaacgctaatgcttctgttggtggatctggtagtttagacaagtacaagggttatgtcgacaacatttacaacactattaacagatatccaaattcaagaattgttatgattcttgaaccagatactattggtaatcttgttactgctaacaatgataattgtagaaacgttcaaaacatgcacaaacaagctctttcttacgccattagtaaattcggtactcaaagtaatgttagagtttatcttgatgctgctcacggtgcttggttaaattcacacgccgatagaactgctcaagttattgctgaaatcttacgtaatgctggtaatggtaagattcgtggtattagtactaacatttctaactaccaacaagttagtgatgaataccaatatcaccaaaaccttaacagagctcttgaaagccaaggtttcagaggtatgaaattcattgttgatacttctcgtaatggtcaaaatgttactgctgccttctctagaaacaacacctggtgtaacttcaagggtgctggtttaggtccacgtccacaagccaatccaaatccaaacatgcctttacttgatgcttacatgtggattaaaactccaggtgaagctgatggttctgctactggttctagagctgatccagtttgtgctagacaagattctcttcaaggtgctccagatgctggttcatggttccacgat

SEQ ID NO: 25262 - DNA, 298 bp, Anaeromyces robustus
  Glycosyl hydrolases family 6, cellulases
gatcaatggtaacccattcaagggtgttgatttctaccttaacccatactacgttgaagaagttgaaaatgctcttaacaatcttattgattcttctcttagatcaaaggttgaaaagatgaagactttctctaatgctatctggcttgataccattaataacatgcaaagttggttagaaccaaaccttaagggtgctcttgctcaacaccaatctactggtaaggatgtcttaactgtctttgttgtttacgatttaccaggtcgtgattgtcacgctcttgcttccaatggtgaa

SEQ ID NO: 25263 - DNA, 1059 bp, Anaeromyces robustus; identical to SEQ ID NO: 25257
  Glycosyl hydrolases family 6, cellulases

SEQ ID NO: 25264 - DNA, 657 bp, Anaeromyces robustus
  Glycosyl hydrolases family 6, cellulases
taattctgaaaacttctttgataatgaactttacattaaccaagattacgttaaaaagattgaatcatctttaaaatctatgtctccagaattacaagctaaggctaagaatgttgaaaaggttgcaactgctgtttggttagcttgggaaggtgctccaggagaagtcgctccacaccttaaggctgctggtaacaagactattacctttattctttacatgattccaactcgtgactgtaacagtttagcttcagctggtggtgctgctgactttgaaaaataccaaggttatgttgacagtattgccgctactattaagaaatatccaaatgctaaggttaacatggttattgaaccagatactcttggtaaccttattactggtgaaactgaagcttgtaagaaggttcatgacttacacagaaaagctttatcttacgctgttaacgttttcggtaacatgagtaatgttaatgcttatcttgatgctgcccaccacaaatggttaggttggggaacagacaaggttgctgctcttatcaaggacattttagacaatgctccagatggtgatattcgtggtattagtactaatgtttctaactaccaatccattgaaaatgaataccaataccactctgatcttcatgactt

SEQ ID NO: 25265 - DNA, 972 bp, Anaeromyces robustus
  Glycosyl hydrolases family 6, cellulases
cttcttcgaaaatgaactttacattaaccaagattacgttaaaaagattgaatctactttaaaggatatgactccagaattacaagctaaggctaagaatgttgaaaaggttgcaactgctgtttggttagcttgggaaggtgctccaggtgaagttgaaccacaccttaaggctgctggtaacaagactattacctttattctttacatgattccaactcgtgactgtaatagtttagcttcagctggtggtgctgctgattttgaaaaataccaaggttatgttgacagtattgctgctactattaagaaatacccagatgctaaggttaacatggttattgaaccagatactcttggtaaccttattactggtgaaactgaagcttgtaagaaggttcatgacttacacagaaaagctttatcttacgccgttaacgttttcggtaacatgagtaatgttaatgcttatcttgatgctgcccaccacaaatggttaggttggggaacagacaaggttgctgctctcattaaggacattttagataatgctccagatggtgatattcgtggtattagtactaatgtttctaactaccaatccattgataatgaataccaataccacactgaccttcacgctgctcttgaagctgtcggtattactggaaagaaattcattgttgataccggtcgtagtggtgttgatgttactgaagaattcaatgttaaccaaacctggtgtaaccttatctacgctggtttaggtgaaaaatctcgtggtaacccagatccagaaaagtacccattattagatgccttcatgtggcttaaaccaccagcagaatctgatggttctgatgttggtagcagagctgatccagtttgtgctcgtgaagattcattcccaggtgctccagacgctggttcatggtttaaggaatatttcattgctatgttagaaaaatctcc

SEQ ID NO: 25266 - DNA, 753 bp, Anaeromyces robustus
  Glycosyl hydrolases family 6, cellulases
tatttctggtaacccattctctggtgttgaattttacattaatccatattatgttgaagaagttgataatgccattgctcaaatgactgattcttctcttaaagctaaagctgaaaaaatgaaaacttatccaaatgctatttggcttgataacattaagaacatgcaaagttggttacaaccaaatcttgaaaaagctcttgctcaacaatctggtagtaaaaaggttttaactgttttcgttgtttacgatttaccaggtcgtgattgtcacgctatggcttccaatggtgaacttcttgctaacgattctgatgctcaacgttacaagactgaatacattgatgttattgaagaacaattaaagaaatacaaatctcaaccaattgtccttattattgaaccagattcacttgctaacatggttactaacattgaaaccactccagcttgtgctgaatctcaagattattactttgatggtcatgcttacttacttaaaaaattcggtgtcttacaacatgttgctatgtaccttgatattggtcacgctttctggttaggttgggatgataaccgtgaaaaggctgctaaggtttacaagaaagttattgattctggttctccaggtaaggttcgtggtttcgttgataacgttgctaactacactccatgggaagacccaactctttctcgtggtccagatactgaatggaacccatgtccagatgaaaagagatacttagaagctat

SEQ ID NO: 25267 - DNA, 994 bp, Anaeromyces robustus
  Glycosyl hydrolases family 6, cellulases
taatccttccttcttcagtggaaatatttacagtaattaccaatatcaatctgaagtccaatcttctattaacaaattaagtggtaatttacaacaacaagctaatagagttaaatacgttccaactgctgtttggttagcttgggatggtgcaccaaaagaagttcaaagacaccttagttccgctaatggcagtactgctgtctttattatgtactggattccaactcgtgattgtaacagtaatgcttctcaaggtggtgctaatgatttaaatgcttacaaatcttatgttgatgatgttgctaatacctttagatctaatcaaggtagtagaattgttattgttgttgaaccagatactattggtaatatggttacttctcaaaacaatgaaaattgtagaagaactgcagttattcacaaacaagctcttgcttatgctgttaatagatttggtagtcttaataatgtacaagtttatcttgatgctggtcacagtcaatggttaactggttatgaagatgaaactgctgctgttattaaggaaattttagatatggctaatcaaggtaagattcgtggtttctctactaatgtttctaacttccaaccaattgataaggaatacgaatatcaaactagactttatgatgctcttgaaaatgttggtattactgatatgagatttgttattgatactagtcgtaatggtcaagatattagtgaagctttcgctaaaactaaaacttggtgtaatttagttggtactggttttggtgaacgtccaaagggtaatccagatccaattaatatgccattattagatgcttacatgtggttaaaaccaccagcagaatctgatggttcttctcaaggtatgcgtgctgatccagtttgtgctcgttctgattctcttccaaatgctccagaagctggttcatggttccatgactatttcgttcaattattgagaaatgccaatccaccattt

SEQ ID NO: 25268 - DNA, 1056 bp, Anaeromyces robustus
  Glycosyl hydrolases family 6, cellulases
agaattttatgttttccctaattatcaaaaacaagttaaaagttcttatgatcaattaattgctgaaggtgaaccagaaattgctgaaattgttgctaaagttgctaaatatccaactccaacctggttaacaaacactgatgctgctaaacttgtaccacaagttttatctcaagttactaaacaaatgaaaaaaactggtaaaaaaattttaacttctttcattatttataatttaccaaacagagattgttcagccgttgcttctcgtggtgaattaggtattgaacatcttggtgtttataaggaatggattgatgaaattgcaggttatttcaaaaatcatgaaggaccaattgttgctgttgttgaaccagatgcttttggtaatatgattaatagtaatgataatgaactttgtaaggaagcctttgatactcaaatggaagctcttgtttatgctattactcatcttaatgctccaaatgttggtgtttatttagatcttgctcaagttggttggttaggttggagtggtaatatgcgtttccttattccacttcttgaagaagttcttaataaggttggtacaggtattttacgtggtttcacttctaatatttctaattatcaaccattagttaaaccagaagttccagaagttactttatccggtaatccaagtcaaagtgaatatgaatatagtttgaatgttagagaagccttaaagaaaattggtatggttgattttggttgggtagttgatacttctcgtaatggtgtatctaatattaaaactaaaggtgaatcatggtgtaatattaaaggtgcaggtataggtagaagaccagaagctaatccaccagatttaccaggacttgatgctgtttattggtttaaaccaccaggtgaatctgatggtagtgatagaaaaggtcaatggggttatgatccatcttgtgaaagtgttgattctcttactgattctccaatggcaggtcaatggtaccataaacaatttgttgaattagctgttaatgctaatccatcatttaa

SEQ ID NO: 25269 - DNA, 1035 bp, Anaeromyces robustus
  Glycosyl hydrolases family 6, cellulases
tccatttgctgaaagtgaattatatgttgatccaaattaccaacaagaacttgataatcttagttcaactataaaggatccaactgttattgaaaaagttgaaaaaatgaaacaatattctactggtatttggttagattctattcaatctgttaatgaattattagaaagtaatttagataatgcttatgctcaacaagtagaaagtggtaaaaatgttttaactacttttgttctttataatttaccaggtcgtgattgtcatgctattactacaaatggtgaacttcttgctaaagattctgatttagaacgttataagcatgaatatattgatgttattgaagaaattataaagaaacataataatcaaccaattgcttttgttgttgaaccaacttctcttccaagtatagctacttttaaaaaaagtactccagcttgtgctgatacagaaaaatattatttagaaggtcattcttatttaattaaaaaacttggtgtattaccaaatgtctttttatatcttgatgttggtcatgctttctggttaggttgggatgatcttcgtgaagaaactgctaaactttatgctaaagttattcaatctggtgctccaggtattgttcgtggttttgctgataatatttcaaattatgttccatgggatgatgctaatcttactaatggtccaaatactgaatataatccatacccagattcaaaaagatatattgaatctttacgtaaagattttgtaagtgttggtattaaaaatgttaatttcatttctgatacttcccttaccactattaataatggttctagtcctgttgaagattggtgttataatgctcctcttggtattggtgctcgtccacaagctaatccagtttcagatatgtcttatcttgatgcttttgtttggattaaaccattctatggtgataaaccatatgattctttatgtcttgaagaaagattaaatactaaaagattatttgaaaaatctgtcaagaatgctaacccaccact

SEQ ID NO: 25270 - DNA, 990 bp, Anaeromyces robustus
  Glycosyl hydrolases family 6, cellulases
taatttcttcaataataagatttactgtaaccaagaccgtaaagatcgtgttcaatcttctattaatagattaagtggtgaattaaaagctaaagcccaaaaaatccaagacgccccaacagctatttggttatcttgggataaagcaccagaaacagtttcgttccatcttgatgaagctggtaatcaaacagccgttttcattttatattggattccaactcgtgattgtaacagtatcgcctctcaaggtggtgctcaaagcatggatgaatatcacacttatgttaacagaattgttaacggtttcaaaagtcatccaaacagtaagatcgttgttgttgttgaaccagatactcttggtaatatgattacttctcaaagtaatgataattgtaaaaaggttcacaatcttcataaacaagctattgcttacgctattgatacctttggtcaaattgacaatgttcgtacttatattgatgctgctcatggtagatggttaggttcacatgctgatgaagcagctgctattattaaagaaattattgatatggcaccaaacagtaatgttcgtggtttatctactaatgtttctaactaccaaccaactgaagatgaatatgcttaccatcaaaaacttagcgctgagcttgaaaagcttggtgttcataatatgaaatttattgttgatactgcccgtaatggtgtagatgtcgcagaatctttagttaaaactggcacttggtgtaatgttaaaggtacaggttttggtgaacgtccaagaggttccccagacccagttaataaaccattattagatgcttacatgtggttaaaaccaggaggtgattctgatggttcatctactggtgatcatgctgatcctgtttgtgaacatgaagattctttaccaggagctggtgatccaggagattggttccatgaatactttgtacaattactcacaaatgccaacccaccaattga

SEQ ID NO: 25271 - DNA, 111 bp, Piromyces finnis
  Glycosyl hydrolases family 6, cellulases
ttatgatccagtttgtgctagtgaagactcacttactgattcaccaagagctggtcaatggttccacaagcaaattgttgaattagccgtcaacgccaatccatcctttgc

SEQ ID NO: 25272 - DNA, 513 bp, Piromyces finnis
  Glycosyl hydrolases family 6, cellulases
agaattctacgttttcccagactaccaaaagcaaatcaagagttcatacgacaagttaattgctgaaggagaaaatgaagttgccgaaattgttgctaaggttgctagatacccaactccaacttggttagctagtactgattccgtcaagcttgttccaaaggttttagcacaagttaccgaacaaatgaagaagaccggtaagaaggttttaacttccttcattatctacaatttaccaaacagagattgttctgctcaagcctccagaggtgaattaggtattgaacatcttggtaagtacaaggaatggattgatgaaattgcaggatactttgcagctcacgaaggaccaattgttgctattgttgaaccagatgccatgggtaacatggttagtcacaatgataatccagtttgtgaagaagcattcgatactcaaatggaagctcttgtctctgccattactaagcttaacatgaagaatgttggtgtttacatggatcttgcaca

SEQ ID NO: 25273 - DNA, 1056 bp, Piromyces finnis
  Glycosyl hydrolases family 6, cellulases
agaattctacgttttcccagactaccaaaagcaaatcaagagttcatacgacaagttaattgctgaaggagaaaatgaagttgccgaaattgttgctaaggttgctagatacccaactccaacttggttagctagtactgattccgtcaagcttgttccaaaggttttagcacaagttaccgaacaaatgaagaagaccggtaagaaggttttaacttccttcattatctacaatttaccaaacagagattgttctgctcaagcctccagaggtgaattaggtattgaacatcttggtaagtacaaggaatggattgatgaaattgcaggatactttgcagctcacgaaggaccaattgttgctattgttgaaccagatgccatgggtaacatggttagtcacaatgataatccagtttgtgaagaagcattcgatactcaaatggaagctcttgtctatgccattactaagcttaacatgaagaatgttggtgtttacatggatcttgcacaagttggatggttaggttggagtggtaacatgcgtttccttattccaattcttgaacaactcttaaacaaggttggtactggagttttacgtggtttctcatctaacatttccaacactcaaccattagttagaccagaaactcttgatgttactttagccggtaacccaagtcaaagtgaatacgaatacagtttgaatgtcagagaagaattaaagaagattggtatggttgactttggatgggttgttgatacttcacgtaatggtgtatctaacattaagaccaagggagaatactggtgtaacattaagggatccggtattggtagaagaccagaagccaatccagcagatcttccaggacttgatgctgtttactggttcaagccaccaggtgaatctgatggtagtgacaacaagaacattattggttatgatccagtttgtgctagtgaagactcacttactgattcaccaagagctggtcaatggttccacaagcaaattgttgaattagccgtcaacgccaatccatcctttgc

SEQ ID NO: 25274 - DNA, 1056 bp, Piromyces finnis; identical to SEQ ID NO: 25273
  Glycosyl hydrolases family 6, cellulases

SEQ ID NO: 25275 - DNA, 658 bp, Piromyces finnis
  Glycosyl hydrolases family 6, cellulases
aactgaaaacttctttgataatgaactttacattagtccaagatacgttgaagaaattgaatcttccatgccagatatgagcgatgaattaaaggctaaggctaagaatgtcatgaatgtttcttctgctgtttggttagcctgggaaggtgctccaaatgaagttgaaggtcatcttaaggctgctggttctaagactattactttcattctttacatgattccaactcgtgattgtaacagtttagcttctgctggtggtgcttctgatcttaagaaataccaaggtattgttgacaagatcgctaataccattagcaagtacccagatgttaaggttgctatggttattgaaccagatactcttggtaaccttattactggttctactgaagcttgtaagaatgttcacactttacacaagaatgctctttcctacgctgctaacgttttcggtaacatgagtaacgttagtgcttaccttgatgctgctcatggtaagtggttaggttgggctgctgacaagactgctgctgtcattaaggaaatcttagacaatgctccaaatgctaacattcgtggtttcagtaccaatgtttctaactatcaatctattgaaaaggaatacgcttatcatgaagctcttaatgctgctctt

SEQ ID NO: 25276 - DNA, 978 bp, Piromyces finnis
  Glycosyl hydrolases family 6, cellulases
ccaaaacttcttcttaaacgaaatctatgctaatccaagattcattgaagaaatcgattcttcaattccaaagttaagtggtgatttagctgctaaggccgaaaaggtcaagcaagttccaactgctgtttggttagcttgggatggtgctccaggtgaagttgaaggtcaccttgctgctgctggttctaagactgttgtcttcattctttacatgattccaactcgtgattgtaacagtttagcttctgctggtggtgcttctgatcttaagaaataccaaggtattgttgacaagatcgctaataccattagcaagtacccagatgttaaggttgctatggttattgaaccagatactcttggtaaccttattactggttctactgaagcttgtaagaatgttcacactttacacaagaatgctctttcctacgctgctaacgttttcggtaacatgagtaacgttagtgcttaccttgatgctgctcatggtaagtggttaggttgggctgctgacaagactgctgctgtcattaaggaaatcttagacaatgctccaaatgctaacattcgtggtttcagtaccaatgtttctaactatcaatctattgaaaaggaatacgcttatcatgaagctcttaatgctgctcttgaaaagcttggtattactggaaagaaattcattgttgataccggtcgtagtggtgttgatgttactgaagaattcgatgttaaccaaacctggtgtaacttcgtttacgctggtttaggtgaaccatctcgcggaagtccagatttagaaaagatgccattattagatgcttacatgtggctcaagccaccaggtgaagctgatggttctgatgttggttccagagctgatccagtttgtggtcgtgaagattcattcccaggttctccagatgctggttcatggttcagtgaatatttcattagtatgttagaaaaatcccc

SEQ ID NO: 25277 - DNA, 981 bp, Piromyces finnis
  Glycosyl hydrolases family 6, cellulases
aactgaaaacttctttgataatgaactttacattagtccaagatacgttgaagaaattgaatcttccatgccagatatgagcgatgaattaaaggctaaggctaataatgtcatgaatgtttcttctgctgtttggttagcctgggaaggtgctccaaatgaagttgaaggtcatcttaaggctgctggttctaagactattactttcattctttacatgattccaactcgtgattgtaacagtttagcttctgctggtggtgcttctgatcttaagaaataccaaggtattgttgacaagatcgctaataccattagcaagtacccagatgttaaggttgctatggttattgaaccagatactcttggtaaccttattactggttctactgaagcttgtaagaatgttcacactttacacaagaatgctctttcctacgctgctaacgttttcggtaacatgagtaacgttagtgcttaccttgatgctgctcatggtaagtggttaggttgggctgctgacaagactgctgctgtcattaaggaaatcttagacaatgctccaaatgctaacattcgtggtttcagtaccaatgtttctaactatcaatctattgaaaaggaatacgcttatcatgaagctcttaatgctgctcttgaaaagcttggtattactggaaagaaattcattgttgataccggtcgtagtggtgttgatgttactgaagaattcgatgttaaccaaacctggtgtaacttcgtttacgctggtttaggtgaaccatctcgcggaagtccagatttagaaaagatgccattattagatgcttacatgtggctcaagccaccaggtgaagctgatggttctgatgttggttccagagctgatccagtttgtggtcgtgaagattcattcccaggttctccagatgctggttcatggttcagtgaatatttcattagtatgttagaaaaatcccc

SEQ ID NO: 25278 - DNA, 981 bp, Piromyces finnis
  Glycosyl hydrolases family 6, cellulases
aactgaaaacttctttgataatgaactttacattagtccaagatacgttgaagaaattgaatcttccatgccagatatgagcgatgaattaaaggctaaggctaataatgtcatgaatgtttcttctgctgtttggttagcctgggaaggtgctccaaatgaagttgaaggtcatcttaaggctgctggttctaagactattactttcattctttacatgattccaactcgtgattgtaacagtttagcttctgctggtggtgcttctgatcttaagaaataccaaggtattgttgacaagatcgctaataccattagcaagtacccagatgttaaggttgctatggttattgaaccagatactcttggtaaccttattactggttctactgaagcttgtaagaatgttcacactttacacaagaatgctctttcctacgctgctaacgttttcggtaacatgagtaacgttagtgcttaccttgatgctgctcatggtaagtggttaggttgggctgctgacaagactgctgctgtcattaaggaaatcttagacaatgctccaaatgctaacattcgtggtttcagtaccaatgtttctaactatcaatctattgaaaaggaatacgcttatcatgaagctcttaatgctgctcttgaaaagcttggtattactggaaagaaattcattgttgataccggtcgtagtggtgttgatgttactgaagaattcgatgttaaccaaacctggtgtaacttcgtttacgctggtttaggtgaaccatctcgcggaagtccagatttagaaaagatgccattattagatgcttacatgtggctcaagccaccaggtgaagctgatggttctgatgttggttccagagctgatccagtttgtggtcgtgaagattcattcccaggttctccagatgctggttcatggttcagtgaatatttcattagtatgttagaaaagtctcc

SEQ ID NO: 25279 - DNA, 621 bp, Piromyces finnis
  Glycosyl hydrolases family 6, cellulases
accagatactcttggtaaccttgtaactggtagcagtgaagcctgtaagactgttcacactttacacaaaaacgccttatcttacgctgttaatgtcttcggtgctatgagtaatgtcagtgtttaccttgatgctgctcacggtaaatggttaggtggtgttactgataaggttgccactgttgttaaagaaattttagatggagctccaaacggtaagattcgtggtttaagtactaatgtttctaactaccaaccagttagcgctgaatatggttaccaccaaaagcttgcttcttctctttctgccgttggtgtaagtgatatgcacttcattgttgataccggtcgtaatggtgttgatgtttcatctaccttcagtattaacgaaacctggtgtaactttgttggtactggttttggtgaacgtccacaaggtaacccatctggtatgccattattagatgcttacatgtggctcaagccaccaggtgaagctgatggttctgatgttggttccagagctgatccagtttgtggtcgtgaagattcattcccaggttctccagatgctggttcatggttcagtgaatatttcattagtatgttagaaaaatcccc

SEQ ID NO: 25280 - DNA, 1099 bp, Piromyces finnis
  Glycosyl hydrolases family 6, cellulases
tcacagtggtaacccattcaagggtcacaagttcttcatcaacccatactacactgctgaagttgatgctgctattgctcaaatgagtaactcttcccttattgctaaggctgaaaagatgaaggaatactctaacgctatctggttagataacattgaaaacatgcaaaactggttagaaagaaaccttaagtctgctcttgctgaacaaaacgctactggtcaaaccgttttaactgtcttcgttgtttacgatttaccaggtcgtgattgtcacgctcttgcttccaatggtgaacttcttgctaatgatgctgatgccgctcgttacaagtctgaatacattgatgtcattgaagaaaagttaaagacttacatttctcaaccagttgttcttattattgaaccagattcccttgctaacatggttaccaacatttctaccactccagcttgtgctgcttctgaaaagtactactacgatggtcatgcttacttaattaagaagctcggtattcttccacacattgctatgtaccttgatattggtcacgctttctggttaggttgggatgataaccgtttaggtgccggtaaggtttactctaaggttatttcctctggttctccaggtcaagttcgtggtttcgcttccaacgttgctaactacactccatgggaagacccagaactttctcgtggtccagacactgaatggaactcttgcccagatgaaaagagatacattgaagccatgtacaaggacttcaagtctgctggtatcaagtctgtctacttcattgaagatacttctcgtaatggtgttaagaacgaccgtttccacccaggagaatggtgtaaccaaatgggatctggtattggtgctcgtccacaagccagtccaattgctggtatggattaccttgatgctttctactgggttaagccatacggtgaatctgatggtacttctgatgaaagtgctaagcgttacgatggttactgtggtcacagaaccgccatgaagccagctccagaagccggtcaatggttccaagccttcttcgaagaaggtcttaagaacgctaacccaccactc

SEQ ID NO: 25281 - DNA, 1099 bp, Piromyces finnis
  Glycosyl hydrolases family 6, cellulases
tcacagtggtaacccattcaagggtcacaagttcttcatcaacccatactacactgctgaagttgatgctgctattgctcaaatgagtgactcctctcttattgctaaggctgaaaagatgaaggaatactctaacgctatctggttagataacattgaaaacatgcaaaactggttagaaagaaaccttaagtctgctcttgctgaacaaaacgctactggtcaaaccgttttaactgtcttcgttgtttacgatttaccaggtcgtgattgtcacgctcttgcttccaatggtgaacttcttgctaatgatgctgatgccgctcgttacaagtctgaatacattgatgtcattgaagaaaagttaaagacttacatttctcaaccagttgttcttattattgaaccagattcccttgctaacatggttaccaacatttctaccactccagcttgtgctgcttctgaaaagtactactacgatggtcatgcttacttaattaagaagctcggtattcttccacacattgctatgtaccttgatattggtcacgctttctggttaggttgggatgataaccgtttaggtgccggtaaggtttactctaaggttatttcctctggttctccaggtcaagttcgtggtttcgcttccaacgttgctaactacactccatgggaagacccagaactttctcgtggtccagacactgaatggaactcttgcccagatgaaaagagatacattgaagccatgtacaaggacttcaagtctgctggtatcaagtctgtctacttcattgaagatacttctcgtaatggtgttaagaacgaccgtttccacccaggagaatggtgtaaccaaatgggatctggtattggtgctcgtccacaagccagtccaattgctggtatggattaccttgatgctttctactgggttaagccatacggtgaatctgatggtacttctgatgaaagtgctaagcgttacgatggttactgtggtcacagaaccgccatgaagccagctccagaagccggtcaatggttccaaaagcactttgaacaaggtcttgaaaatgctaacccaccactt

SEQ ID NO: 25282 - DNA, 1099 bp, Piromyces finnis
  Glycosyl hydrolases family 6, cellulases
tcacagtggtaacccattcaagggtcacaagttcttcatcaacccatactacactgctgaagttgatgctgctattgctcaaatgagtaactcttcccttattgctaaggctgaaaagatgaaggaatactctaacgctatctggttagataacattgaaaacatgcaaaactggttagaaagaaaccttaagtctgctcttgctgaacaaaacgctactggtcaaaccgttttaactgtcttcgttgtttacgatttaccaggtcgtgattgtcacgctcttgcttccaatggtgaacttcttgctaatgatgctgatgccgctcgttacaagtctgaatacattgatgtcattgaagaaaagttaaagacttacatttctcaaccagttgttcttattattgaaccagattcccttgctaacatggttaccaacatttctaccactccagcttgtgctgcttctgaaaagtactactacgatggtcatgcttacttaattaagaagctcggtattcttccacacattgctatgtaccttgatattggtcacgctttctggttaggttgggatgataaccgtttaggtgccggtaaggtttactctaaggttatttcctctggttctccaggtcaagttcgtggtttcgcttccaacgttgctaactacactccatgggaagacccagaactttctcgtggtccagacactgaatggaactcttgcccagatgaaaagagatacattgaagccatgtacaaggacttcaagtctgctggtatcaagtctgtctacttcattgaagatacttctcgtaatggtgttaagaacgaccgtttccacccaggagaatggtgtaaccaaatgggatctggtattggtgctcgtccacaagccagtccaattgctggtatggattaccttgatgctttctactgggttaagccatacggtgaatctgatggtacttctgatgaaagtgctaagcgttacgatggttactgtggtcacagaaccgccatgaagccagctccagaagccggtcaatggttccaagccttcttcgaagaaggtcttaagaacgctaacccaccactt

SEQ ID NO: 25283 - DNA, 1099 bp, Piromyces finnis
  Glycosyl hydrolases family 6, cellulases
tcactctggtaacccattcaagggtcacaagttcttcatcaacccatactacactgctgaagttgatgctgctattgctcaaatgagtaactcttcccttattgctaaggctgaaaagatgaaggaatactctaacgctatctggttagataacattgaaaacatgcaaaactggttagaaagaaaccttaagtctgctcttgctgaacaaaacgctactggtcaaaccgttttaactgtcttcgttgtttacgatttaccaggtcgtgattgtcacgctcttgcttccaatggtgaacttcttgctaatgatgctgatgccgctcgttacaagtctgaatacattgatgtcattgaagaaaagttaaagacttacatttctcaaccagttgttcttattattgaaccagattcccttgctaacatggttaccaacatttctaccactccagcttgtgctgcttctgaaaagtactactacgatggtcatgcttacttaattaagaagctcggtattcttccacacattgctatgtaccttgatattggtcacgctttctggttaggttgggatgataaccgtttaggtgccggtaaggtttactctaaggttatttcctctggttctccaggtcaagttcgtggtttcgcttccaacgttgctaactacactccatgggaagacccagaactttctcgtggtccagacactgaatggaactcttgcccagatgaaaagagatacattgaagccatgtacaaggacttcaagtctgctggtatcaagtctgtctacttcattgaagatacttctcgtaatggtgttaagaacgaccgtttccacccaggagaatggtgtaaccaaatgggatctggtattggtgctcgtccacaagccagtccaattgctggtatggattaccttgatgctttctactgggttaagccatacggtgaatctgatggtacttctgatgaaagtgctaagcgttacgatggttactgtggtcacagaaccgccatgaagccagctccagaagccggtcaatggttccaagccttcttcgaagaaggtcttaagaacgctaacccaccactt

SEQ ID NO: 25284 - DNA, 1099 bp, Piromyces finnis
  Glycosyl hydrolases family 6, cellulases
tcactctggtaacccattcaagggtcacaagttcttcatcaacccatactacactgctgaagttgatgctgccatcgctcaaatgtctaactcttcccttattgctaaggctgaaaagatgaaggaatactctaacgctatttggttagataccattgaaaacatgaacaattggttagaaagaaaccttaagactgctcttgctgaacaaaaccaaactggtaagactgtcttaaccgttttcgttgtttacgatttaccaggtcgtgattgtcacgctcttgcttccaatggtgaacttcttgctaatgatgctgatgccgctcgttacaagtctgaatacattgatgtcattgaagaaaagttaaagacttacatttctcaaccagttgttcttattattgaaccagattcccttgctaacatggttaccaacatttctaccactccagcttgtgctgcttctgaaaagtactactacgatggtcatgcttacttaattaagaagctcggtattcttccacacattgctatgtaccttgatattggtcacgctttctggttaggttgggatgataaccgtttaggtgccggtaaggtttactctaaggttatttcctctggttctccaggtcaagttcgtggtttcgcttccaacgttgctaactacactccatgggaagacccagaactttctcgtggtccagacactgaatggaactcttgcccagatgaaaagagatacattgaagccatgtacaaggacttcaagtctgctggtatcaagtctgtctacttcattgaagatacttctcgtaatggtgttaagaacgaccgtttccacccaggagaatggtgtaaccaaatgggatctggtattggtgctcgtccacaagccagtccaattgctggtatggattaccttgatgctttctactgggttaagccatacggtgaatctgatggtacttctgatgaaagtgctaagcgttacgatggttactgtggtcacagaaccgccatgaagccagctccagaagccggtcaatggttccaagccttcttcgaagaaggtcttaagaacgctaacccaccactc

SEQ ID NO: 25285 - DNA, 1099 bp, Piromyces finnis
  Glycosyl hydrolases family 6, cellulases
tcacagtggtaacccattcaagggtcacaagttcttcatcaacccatactacactgctgaagttgatgctgctattgctcaaatgagtaactcttcccttattgctaaggctgaaaagatgaaggaatactctaacgctatctggttagataacattgaaaacatgcaaaactggttagaaagaaaccttaagtctgctcttgctgaacaaaacgctactggtcaaaccgttttaactgtcttcgttgtttacgatttaccaggtcgtgattgtcacgctcttgcttccaatggtgaacttcttgctaatgatgctgatgccgctcgttacaagtctgaatacattgatgtcattgaagaaaagttaaagacttacatttctcaaccagttgttcttattattgaaccagattcccttgctaacatggttaccaacatttctaccactccagcttgtgctgcttctgaaaagtactactacgatggtcatgcttacttaattaagaagctcggtattcttccacacattgctatgtaccttgatattggtcacgctttctggttaggttgggatgataaccgtttaggtgccggtaaggtttactctaaggttatttcctctggttctccaggtcaagttcgtggtttcgcttccaacgttgctaactacactccatgggaagacccagaactttctcgtggtccagacactgaatggaactcttgcccagatgaaaagagatacattgaagccatgtacaaggacttcaagtctgctggtatcaagtctgtctacttcattgaagatacttctcgtaatggtgttaagaacgaccgtttccacccaggagaatggtgtaaccaaatgggatctggtattggtgctcgtccacaagccagtccaattgctggtatggattaccttgatgctttctactgggttaagccatacggtgaatctgatggtacttctgatgaaagtgctaagcgttacgatggttactgtggtcacagaaccgccatgaagccagctccagaagccggtcaatggttccaaaagcactttgaacaaggtcttgaaaatgctaacccaccactt

SEQ ID NO: 25286 - DNA, 1099 bp, Piromyces finnis
  Glycosyl hydrolases family 6, cellulases
tcactctggtaacccattcaagggtcacaagttcttcatcaacccatactacactgctgaagttgatgctgccatcgctcaaatgtctaactcttcccttattgctaaggctgaaaagatgaaggaatactctaacgctatttggttagataccattgaaaacatgaacaattggttagaaagaaaccttaagactgctcttgctgaacaaaaccaaactggtaagactgtcttaaccgttttcgttgtttacgatttaccaggtcgtgattgtcacgctcttgcttccaatggtgaacttcttgctaatgatgctgatgccgctcgttacaagtctgaatacattgatgtcattgaagaaaagttaaagacttacatttctcaaccagttgttcttattattgaaccagattcccttgctaacatggttaccaacatttctaccactccagcttgtgctgcttctgaaaagtactactacgatggtcatgcttacttaattaagaagctcggtattcttccacacattgctatgtaccttgatattggtcacgctttctggttaggttgggatgataaccgtttaggtgccggtaaggtttactctaaggttatttcctctggttctccaggtcaagttcgtggtttcgcttccaacgttgctaactacactccatgggaagacccagaactttctcgtggtccagacactgaatggaactcttgcccagatgaaaagagatacattgaagccatgtacaaggacttcaagtctgctggtatcaagtctgtctacttcattgaagatacttctcgtaatggtgttaagaacgaccgtttccacccaggagaatggtgtaaccaaatgggatctggtattggtgctcgtccacaagccagtccaattgctggtatggattaccttgatgctttctactgggttaagccatacggtgaatctgatggtacttctgatgaaagtgctaagcgttacgatggttactgtggtcacagaaccgccatgaagccagctccagaagccggtcaatggttccaaaagcactttgaacaaggtcttgaaaatgctaacccaccactt

SEQ ID NO: 25287 - DNA, 1099 bp, Piromyces finnis
  Glycosyl hydrolases family 6, cellulases
tcacagtggtaacccattcaagggtcacaagttcttcatcaacccatactacactgctgaagttgatgctgctattgctcaaatgagtgactcctctcttattgctaaggctgaaaagatgaaggaatactctaacgctatctggttagataacattgaaaacatgcaaaactggttagaaagaaaccttaagtctgctcttgctgaacaaaacgctactggtcaaaccgttttaactgtcttcgttgtttacgatttaccaggtcgtgattgtcacgctcttgcttccaatggtgaacttcttgctaatgatgctgatgccgctcgttacaagtctgaatacattgatgtcattgaagaaaagttaaagacttacatttctcaaccagttgttcttattattgaaccagattcccttgctaacatggttaccaacatttctaccactccagcttgtgctgcttctgaaaagtactactacgatggtcatgcttacttaattaagaagctcggtattcttccacacattgctatgtaccttgatattggtcacgctttctggttaggttgggatgataaccgtttaggtgccggtaaggtttactctaaggttatttcctctggttctccaggtcaagttcgtggtttcgcttccaacgttgctaactacactccatgggaagacccagaactttctcgtggtccagacactgaatggaactcttgcccagatgaaaagagatacattgaagccatgtacaaggacttcaagtctgctggtatcaagtctgtctacttcattgaagatacttctcgtaatggtgttaagaacgaccgtttccacccaggagaatggtgtaaccaaatgggatctggtattggtgctcgtccacaagccagtccaattgctggtatggattaccttgatgctttctactgggttaagccatacggtgaatctgatggtacttctgatgaaagtgctaagcgttacgatggttactgtggtcacagaaccgccatgaagccagctccagaagccggtcaatggttccaagccttcttcgaagaaggtcttaagaacgctaacccaccactt

SEQ ID NO: 25288 - DNA, 1099 bp, Piromyces finnis
  Glycosyl hydrolases family 6, cellulases
tcacagtggtaacccattcaagggtcacaagttcttcatcaacccatactacactgctgaagttgatgctgctattgctcaaatgagtgactcctctcttattgctaaggctgaaaagatgaaggaatactctaacgctatctggttagataacattgaaaacatgcaaaactggttagaaagaaaccttaagtctgctcttgctgaacaaaacgctactggtcaaaccgttttaactgtcttcgttgtttacgatttaccaggtcgtgattgtcacgctcttgcttccaatggtgaacttcttgctaatgatgctgatgccgctcgttacaagtctgaatacattgatgtcattgaagaaaagttaaagacttacatttctcaaccagttgttcttattattgaaccagattcccttgctaacatggttaccaacatttctaccactccagcttgtgctgcttctgaaaagtactactacgatggtcatgcttacttaattaagaagctcggtattcttccacacattgctatgtaccttgatattggtcacgctttctggttaggttgggatgataaccgtttaggtgccggtaaggtttactctaaggttatttcctctggttctccaggtcaagttcgtggtttcgcttccaacgttgctaactacactccatgggaagacccagaactttctcgtggtccagacactgaatggaactcttgcccagatgaaaagagatacattgaagccatgtacaaggacttcaagtctgctggtatcaagtctgtctacttcattgaagatacttctcgtaatggtgttaagaacgaccgtttccacccaggagaatggtgtaaccaaatgggatctggtattggtgctcgtccacaagccagtccaattgctggtatggattaccttgatgctttctactgggttaagccatacggtgaatctgatggtacttctgatgaaagtgctaagcgttacgatggttactgtggtcacagaaccgccatgaagccagctccagaagccggtcaatggttccaagccttcttcgaagaaggtcttaagaacgctaacccaccactc

SEQ ID NO: 25289 - DNA, 1099 bp, Piromyces finnis; identical to SEQ ID NO: 25288
  Glycosyl hydrolases family 6, cellulases

SEQ ID NO: 25290 - DNA, 1099 bp, Piromyces finnis; identical to SEQ ID NO: 25282
  Glycosyl hydrolases family 6, cellulases

SEQ ID NO: 25291 - DNA, 1099 bp, Piromyces finnis; identical to SEQ ID NO: 25281
  Glycosyl hydrolases family 6, cellulases

SEQ ID NO: 25292 - DNA, 1099 bp, Piromyces finnis
  Glycosyl hydrolases family 6, cellulases
tcactctggtaacccattcaagggtcacaagttcttcatcaacccatactacactgctgaagttgatgctgctattgctcaaatgagtaactcttcccttattgctaaggctgaaaagatgaaggaatactctaacgctatctggttagataacattgaaaacatgcaaaactggttagaaagaaaccttaagtctgctcttgctgaacaaaacgctactggtcaaaccgttttaactgtcttcgttgtttacgatttaccaggtcgtgattgtcacgctcttgcttccaatggtgaacttcttgctaatgatgctgatgccgctcgttacaagtctgaatacattgatgtcattgaagaaaagttaaagacttacatttctcaaccagttgttcttattattgaaccagattcccttgctaacatggttaccaacatttctaccactccagcttgtgctgcttctgaaaagtactactacgatggtcatgcttacttaattaagaagctcggtattcttccacacattgctatgtaccttgatattggtcacgctttctggttaggttgggatgataaccgtttaggtgccggtaaggtttactctaaggttatttcctctggttctccaggtcaagttcgtggtttcgcttccaacgttgctaactacactccatgggaagacccagaactttctcgtggtccagacactgaatggaactcttgcccagatgaaaagagatacattgaagccatgtacaaggacttcaagtctgctggtatcaagtctgtctacttcattgaagatacttctcgtaatggtgttaagaacgaccgtttccacccaggagaatggtgtaaccaaatgggatctggtattggtgctcgtccacaagccagtccaattgctggtatggattaccttgatgctttctactgggttaagccatacggtgaatctgatggtacttctgatgaaagtgctaagcgttacgatggttactgtggtcacagaaccgccatgaagccagctccagaagccggtcaatggttccaaaagcactttgaacaaggtcttgaaaatgctaacccaccactt

SEQ ID NO: 25293 - DNA, 1099 bp, Piromyces finnis; identical to SEQ ID NO: 25285
  Glycosyl hydrolases family 6, cellulases

SEQ ID NO: 25294 - DNA, 1099 bp, Piromyces finnis
  Glycosyl hydrolases family 6, cellulases
tcactctggtaacccattcaagggtcacaagttcttcatcaacccatactacactgctgaagttgatgctgctattgctcaaatgagtaactcttcccttattgctaaggctgaaaagatgaaggaatactctaacgctatctggttagataacattgaaaacatgcaaaactggttagaaagaaaccttaagtctgctcttgctgaacaaaacgctactggtcaaaccgttttaactgtcttcgttgtttacgatttaccaggtcgtgattgtcacgctcttgcttccaatggtgaacttcttgctaatgatgctgatgccgctcgttacaagtctgaatacattgatgtcattgaagaaaagttaaagacttacatttctcaaccagttgttcttattattgaaccagattcccttgctaacatggttaccaacatttctaccactccagcttgtgctgcttctgaaaagtactactacgatggtcatgcttacttaattaagaagctcggtattcttccacacattgctatgtaccttgatattggtcacgctttctggttaggttgggatgataaccgtttaggtgccggtaaggtttactctaaggttatttcctctggttctccaggtcaagttcgtggtttcgcttccaacgttgctaactacactccatgggaagacccagaactttctcgtggtccagacactgaatggaactcttgcccagatgaaaagagatacattgaagccatgtacaaggacttcaagtctgctggtatcaagtctgtctacttcattgaagatacttctcgtaatggtgttaagaacgaccgtttccacccaggagaatggtgtaaccaaatgggatctggtattggtgctcgtccacaagccagtccaattgctggtatggattaccttgatgctttctactgggttaagccatacggtgaatctgatggtacttctgatgaaagtgctaagcgttacgatggttactgtggtcacagaaccgccatgaagccagctccagaagccggtcaatggttccaagccttcttcgaagaaggtcttaagaacgctaacccaccactc

SEQ ID NO: 25295 - DNA, 1099 bp, Piromyces finnis; identical to SEQ ID NO: 25287
  Glycosyl hydrolases family 6, cellulases

SEQ ID NO: 25296 - DNA, 1099 bp, Piromyces finnis; identical to SEQ ID NO: 25280
  Glycosyl hydrolases family 6, cellulases

SEQ ID NO: 25297 - DNA, 1099 bp, Piromyces finnis
  Glycosyl hydrolases family 6, cellulases
tcactctggtaacccattcaagggtcacaagttcttcatcaacccatactacactgctgaagttgatgctgccatcgctcaaatgtctaactcttcccttattgctaaggctgaaaagatgaaggaatactctaacgctatttggttagataccattgaaaacatgaacaattggttagaaagaaaccttaagactgctcttgctgaacaaaaccaaactggtaagactgtcttaaccgttttcgttgtttacgatttaccaggtcgtgattgtcacgctcttgcttccaatggtgaacttcttgctaatgatgctgatgccgctcgttacaagtctgaatacattgatgtcattgaagaaaagttaaagacttacatttctcaaccagttgttcttattattgaaccagattcccttgctaacatggttaccaacatttctaccactccagcttgtgctgcttctgaaaagtactactacgatggtcatgcttacttaattaagaagctcggtattcttccacacattgctatgtaccttgatattggtcacgctttctggttaggttgggatgataaccgtttaggtgccggtaaggtttactctaaggttatttcctctggttctccaggtcaagttcgtggtttcgcttccaacgttgctaactacactccatgggaagacccagaactttctcgtggtccagacactgaatggaactcttgcccagatgaaaagagatacattgaagccatgtacaaggacttcaagtctgctggtatcaagtctgtctacttcattgaagatacttctcgtaatggtgttaagaacgaccgtttccacccaggagaatggtgtaaccaaatgggatctggtattggtgctcgtccacaagccagtccaattgctggtatggattaccttgatgctttctactgggttaagccatacggtgaatctgatggtacttctgatgaaagtgctaagcgttacgatggttactgtggtcacagaaccgccatgaagccagctccagaagccggtcaatggttccaagccttcttcgaagaaggtcttaagaacgctaacccaccactt

SEQ ID NO: 25298 - DNA, 988 bp, Piromyces finnis
  Glycosyl hydrolases family 6, cellulases
tagcgacaacttctttgataatactctctacagtaacttcaagttccaagctgaagttcaatcttctattaacaagttaagtggttccttagctgaaaaggctaagaaggttaagtacgtcccaactgctgcttggttagcttgggaaggtgctccagctgaagttccacaataccttgatgaagctggttccaacactgttgttttcgtcttatatatgattccaactcgtgattgtaacgctaacgcctctgctggtggtagttccaacattgaaaagtacaagggttacgttgacaagatctacaacactattaaccaatatccaaactctagaattgttatgattcttgaaccagatactattggtaaccttgttactgctaacaatgacaactgtagaaacgtccaaaacatgcacaagcaagccctttcttacgctattagtaagttcggtacccaaagtaacgtcagagtttaccttgatgctgctcacggtgcttggttatctagccacgctgacaagactgcccaagttattaaggaaatcttaaacaacgctggtaacggtaaacttcgtggtatcagtactaacgtttctaactaccaaactgttaacgatgaatacaactaccacatgagacttaacagtgccctcgaaaaccttggtgttagaggtatgaaattcattgttgatacttcccgtaacggtgctaacatttctggtgctttcaatgctagtggtacctggtgtaacttcaagggtgctggtttaggtgctcgtccacaaggtagcccagacccaagcaagccattacttgatgcttacatgtggattaagactccaggtgaagctgatggttcttctagcggttctagagctgatccagtctgtgctcgttacgattctcttcaaggtgctccagatgctggttcttggttccatgattacttcgttatgttagtccaaaacgctaacccagccttc

SEQ ID NO: 25299 - DNA, 1099 bp, Piromyces finnis
  Glycosyl hydrolases family 6, cellulases
tcacagtggtaacccattcaagggtcacaaattcttcatcaacccatactacactgctgaagttgatgctgctattgctcaaatgagtgactcctctcttattgctaaggctgaaaagatgaaggaatactctaacgctatctggttagataacattgaaaacatgcaaaactggttagaaagaaaccttaagtctgctcttgctgaacaaaacgccactggtcaaactgtcttaactgtctttgttgtttacgatttaccaggtcgtgattgtcacgctcttgcttccaatggtgaacttcttgccaacgatgctgatgccgctcgttacaagtctgaatacattgatgtcattgaagaaaagttaaagacttacatttctcaaccagttgttcttattattgaaccagattcccttgctaacatggttaccaacatttctaccactccagcttgtgctgcttctgaaaagtactactacgatggtcatgcttacttaattaagaagctcggtattcttccacacattgctatgtaccttgatattggtcacgccttctggttaggttgggatgataaccgtttaggtgccggtaaggtttactctaaggttatttcctctggttctccaggtcaagttcgtggtttcgcttccaacgttgctaactacactccatgggaagacccagaactttctcgtggtccagacactgaatggaactcttgcccagatgaaaagagatacattgaagccatgtacaaggacttcaagtctgctggtatcaagtctgtctacttcattgaagatacttctcgtaatggtgttaagaacgaccgtttccacccaggagaatggtgtaaccaaatgggatctggtattggtgcccgtccacaagccaacccaattgccggtatggattaccttgatgctttctactgggttaagccatacggtgaatctgatggtacttctgatgaaagtgctaagcgttacgatggttactgtggtcacagaaccgccatgaagccagctccagaagccggtcaatggttccaagccttcttcgaagaaggtcttaagaacgctaacccaccactt

SEQ ID NO: 25300 - DNA, 1099 bp, Piromyces finnis
  Glycosyl hydrolases family 6, cellulases
tcacagtggtaacccattcaagggtcacaaattcttcatcaacccatactacactgctgaagttgatgctgctattgctcaaatgagtgactcctctcttattgctaaggctgaaaagatgaaggaatactctaacgctatctggttagataacattgaaaacatgcaaaactggttagaaagaaaccttaagtctgctcttgctgaacaaaacgccactggtcaaactgtcttaactgtctttgttgtttacgatttaccaggtcgtgattgtcacgctcttgcttccaatggtgaacttcttgccaacgatgctgatgccgctcgttacaagtctgaatacattgatgtcattgaagaaaagttaaagacttacatttctcaaccagttgttcttattattgaaccagattcccttgctaacatggttaccaacattgaatctactccagcttgtgctaagtctgaaaagtactactacgatggtcacgcttacttaattaagaagttcggtgttcttccacacgtttctatgtaccttgatattggtcacgctttctggttaggttgggatgacaaccgtgaaaaggccggtaaggtttactctaaggttatttcctctggttctccaggtcaagttcgtggtttcgcttccaacgttgctaactacactccatgggaagacccagaactttctcgtggtccagacactgaatggaactcttgcccagatgaaaagagatacattgaagccatgtacaaggacttcaagtctgctggtatcaagtctgtctacttcattgaagatacttctcgtaatggtgttaagaacgaccgtttccacccaggagaatggtgtaaccaaatgggatctggtattggtgcccgtccacaagccaacccaattgccggtatggattaccttgatgctttctactgggttaagccatacggtgaatctgatggtacttctgatgaaagtgctaagcgttacgatggttactgtggtcacagaaccgccatgaagccagctccagaagccggtcaatggttccaagccttcttcgaagaaggtcttaagaacgctaacccaccactc

SEQ ID NO: 25301 - DNA, 1099 bp, Piromyces finnis; identical to SEQ ID NO: 25299
  Glycosyl hydrolases family 6, cellulases

SEQ ID NO: 25302 - DNA, 1099 bp, Piromyces finnis; identical to SEQ ID NO: 25300
  Glycosyl hydrolases family 6, cellulases

SEQ ID NO: 25303 - DNA, 1099 bp, Piromyces finnis; identical to SEQ ID NO: 25300
  Glycosyl hydrolases family 6, cellulases

SEQ ID NO: 25304 - DNA, 1098 bp, Piromyces finnis
  Glycosyl hydrolases family 6, cellulases
tcacagtggtaacccattcaagggtcacaaattcttcatcaacccatactacactgctgaagttgatgctgctattgctcaaatgagtgactcctctcttattgctaaggctgaaaagatgaaggaatactctaacgctatctggttagataacattgaaaacatgcaaaactggttagaaagaaaccttaagtctgctcttgctgaacaaaacgccactggtcaaactgtcttaactgtctttgttgtttacgatttaccaggtcgtgattgtcacgctcttgcttccaatggtgaacttcttgccaacgatgctgatgccgctcgttacaagtctgaatacattgatgtcattgaagaaaagttaaagacttacatttctcaaccagttgttcttattattgaaccagattcccttgctaacatggttaccaacatttctaccactccagcttgtgctgcttctgaaaagtactactacgatggtcatgcttacttaattaagaagctcggtattcttccacacattgctatgtaccttgatattggtcacgccttctggttaggttgggatgataaccgtttaggtgccggtaaggtttactctaaggttatttcctctggttctccaggtcaagttcgtggtttcgcttccaacgttgctaactacactccatgggaagacccagaactttctcgtggtccagacactgaatggaactcttgcccagatgaaaagagatacattgaagccatgtacaaggacttcaagtctgctggtatcaagtctgtctacttcattgaagatacttctcgtaatggtgttaagaacgaccgtttccacccaggagaatggtgtaaccaaatgggatctggtattggtgcccgtccacaagccaacccaattgccggtatggattaccttgatgctttctactgggttaagccatacggtgaatctgatggtacttctgatgaaagtgctaagcgttacgatggttactgtggtcacagaaccgccatgaagccagctccagaagccggtcaatggttccaagccttcttcgaagaaggtcttaagaacgctaacccaccaca

SEQ ID NO: 25305 - DNA, 1098 bp, Piromyces finnis; identical to SEQ ID NO: 25304
  Glycosyl hydrolases family 6, cellulases

SEQ ID NO: 25306 - DNA, 1099 bp, Piromyces finnis; identical to SEQ ID NO: 25299
  Glycosyl hydrolases family 6, cellulases

SEQ ID NO: 25307 - DNA, 1098 bp, Piromyces finnis; identical to SEQ ID NO: 25304
  Glycosyl hydrolases family 6, cellulases

SEQ ID NO: 25308 - DNA, 1099 bp, Piromyces finnis; identical to SEQ ID NO: 25299
  Glycosyl hydrolases family 6, cellulases

SEQ ID NO: 25309 - DNA, 1099 bp, Piromyces finnis; identical to SEQ ID NO: 25300
  Glycosyl hydrolases family 6, cellulases

SEQ ID NO: 25310 - DNA, 1098 bp, Piromyces finnis; identical to SEQ ID NO: 25304
  Glycosyl hydrolases family 6, cellulases

SEQ ID NO: 25311 - DNA, 477 bp, Neocallimastix californiae
  GLYCOSYL TRANSFERASE-RELATED
ctacgttggtatctacggttggatggataatccacaaattgaatactatgttgttgatgactggcttcataacagaggtgctccaggtggttcttacatgggttcacaaaagggtaccattaatgttgatggtggtacatacaaggtttggactggtactcgtactggtgcttctaagtggggtcaatctaccttcactcaaattttctctgttcgtactcaacaacgtacttgtggtcaaattaacatttctgaacatttcagacaatgggaaaaattaggtattagagttggtcaacttatggaagctcaaattttagctgaatctggtggtggttctggttacgttgatttcacttacgctactgttgaaattggtagtggatcttctagtggaaatggcggaaacggaggaaatggcggaaacggtaaccaaaacccatggggaggacaacaaaatcaaggtcaaggtcaagg

SEQ ID NO: 25312 - DNA, 189 bp, Neocallimastix californiae
  GLYCOSYL TRANSFERASE-RELATED
tgatttcactattgatggtgctaagtacactgtttatgaaaatacacgttatggtccatctattgatggtgatactactttcaaacaattctttagtattcgtcaacaagctcgtgattgtggtactattgatattactgctcactttgaacaatgggaaaagcttggtatgaaacttggtaagatgca

SEQ ID NO: 25313 - DNA, 312 bp, Neocallimastix californiae
  GLYCOSYL TRANSFERASE-RELATED
ttattcttatgttggtgtttacggttggactttagaatctggtatttctggagtctttgaattttacattgtcgataattggctttctcaatatagaccaggtgattgggttggtaatcaaaagaagggtgacttcactattgatggtgctgtatacactgtatacaaaaatgttaatggtaatcttactcaatacttcagtcttcgtagagaaccacgtacctgtggtactattgatgttactgctcactttgaccaatgggaaaaattaggtttgaaaatgggaaagattagtgaaattaaggttttagg

SEQ ID NO: 25314 - DNA, 300 bp, Neocallimastix californiae
  GLYCOSYL TRANSFERASE-RELATED
ttacattggtatctacggttggaccagaaatccacttgttgaattctacgttgttgataactggcttagtcaatatcgtccaggtgattgggttggtaacaaaaagcatggtgatttcactattgatggtgctagatacactgtttatgaaaatactcgttacggtccatctattgatggtaacactaattttaagcaatacttcagtatccgtcaaactgctcgtgactgtggtactattgatattactgctcacttccaacaatgggaaaaacttggtatgactatgggtaagatgca

SEQ ID NO: 25315 - DNA, 318 bp, Neocallimastix californiae
  GLYCOSYL TRANSFERASE-RELATED
ggatccacttgtcgaattctatgttgttgataactggctcagtcaatggcgtccaggagattgggtaggaaacaagaagcatggtgattacgttattgatggtgctacctacactgtttatgaaaatgaacgttatggtccatccattgttggtgatactaacttcaagcaattcttcagtattcgtaaggaagctcgtgactgtggtactattgatattaccgctcacttcttacaatgggaaaaacttggaatgaaattaggtaagatgtatgaagctaaggttttaggagaagctggtagtaacagttccggtac

SEQ ID NO: 25316 - DNA, 345 bp, Neocallimastix californiae
  GLYCOSYL TRANSFERASE-RELATED
ctatgtcggtatttacggttggaccagaaatccacttgttgaattctacgttgttgataactggctcagtcaatggcgtccaggagattgggttggtaacaagaagcatggtgatttcactattgatggtgctaaatacacagtttatgaaaacacacgttacggtccatccattgatggtgataccaacttcaagcaattcttcagtatccgtcaaactgctcgtgactgtggtaccattgatattacagctcactttgaacaatgggaaaaacttggtatgaaattaggtaagatgcatgaagctaaagttttaggtgaagctggtagtactggttctggtac

SEQ ID NO: 25317 - DNA, 303 bp, Neocallimastix californiae
  GLYCOSYL TRANSFERASE-RELATED
atacattggtatttatggttggactcgtgaaccacttgttgaatactatgttgttgataactggcttagtcaataccgtccaggtgactgggttggaaacaagaaatatggtgatttcgaaattgatggtgctgaatacactgtttatgaaaacactcgtactggtccatctattgatggtgataatgttactttcaaacaatacttcagtattcgtaaagaagctcgtgactgtggtactattgatattacagcccattttgaaaaatgggaagaacttgatttagttcttggtaagatgca

SEQ ID NO: 25318 - DNA, 492 bp, Neocallimastix californiae
  GLYCOSYL TRANSFERASE-RELATED
ctacattggtatttacggttggatggataacccacaaattgaatactatgttgttgatgactggttacataacagaggagctccaggaggttcatggatgggtcaacaaaagggtactattaatgttgatggtggtacatacaaggtttggtctggacaacgtactggagcttctaaatggggtcaatctactttcacacaaattttctccgttcgtacttcacaacgtcaatgtggtcaaattaacatttctgaacacttcagacaatgggaaaaattaggtcttagaattggtcaagtcatggaagcccaaattttagctgaagctggtggtggttctggttatgttgatttcacttacgctaccgtagaaattggtagtggtagtagtcaaggaggtaaccaaggaggtaaccaaggtggtaacaataatcaaggaggtaaccaaggaggaaatcaaggtggtaacaaccaatggaatccatggggtaa

SEQ ID NO: 25319 - DNA, 303 bp, Neocallimastix californiae
  GLYCOSYL TRANSFERASE-RELATED
atacattggtatttatggttggactcgtgaaccacttgttgaatattatgttgttgataactggcttagtcaataccgtccaggtgattgggttggaaataagaaatatggagatttcgaaattgatggtgctgaatatactgtttatgaaaatactcgtactggaccatctattgatggagataatgttactttcaaacaatacttcagtattcgtaaagaagctcgtgactgtggtactattgatattaccgcccactttgaaaagtgggaagaacttggtttaacccttggtaaaatgca

SEQ ID NO: 25320 - DNA, 300 bp, Neocallimastix californiae
  GLYCOSYL TRANSFERASE-RELATED
ttataactatattggtatctatggttggactgtcgatccattagtagaatactatattgtagatgactggtacaataaaccaggttcttaccttggacaaaagaagggtgaattcactgttgatggtgatacttacgaaattttccaaaatactcgtgttaaccaaccatctattaagggtacttcaaccttcccacaattcttcagtgttcgtcgtagtgctcgttcttgtggtcatattgatattagtgctcacttcaagaagtgggaatccctcggtatgaaattaggtaagatgta

SEQ ID NO: 25321 - DNA, 483 bp, Neocallimastix californiae
  GLYCOSYL TRANSFERASE-RELATED
ttatattggtgtttacggttggagtagagatccacttgttgaatattacgttgtagataattggcttagtcaatatcgtccaggagattgggttggtaataagaaacatggtgatttcactattgatggtgctaaatacactgtttatgaaaatactcgttatggtccatctattgatggtgatactcaatttaaacaatatttcagtattcgtcaacaagcacgtgattgtggtaccattgatattacagctcatttccaacaatgggaaaaacttggtatgaaacttggtaaaatgcatgaagctaaagttttaggagaagcaggtagtaatggatcaggtactagtggtacagccgatttcccatatgctaaagtctatattggtagtggaggcaacactggtggtaactctggtggtaattctggtggtaatactggaggtaattctggtggtaacactggaggtaattctggtggtaa

SEQ ID NO: 25322 - DNA, 300 bp, Anaeromyces robustus; identical to SEQ ID NO: 25320
  GLYCOSYL TRANSFERASE-RELATED

SEQ ID NO: 25323 - DNA, 300 bp, Anaeromyces robustus
  GLYCOSYL TRANSFERASE-RELATED
atacgttggtatttacggttggactagaaacccacttgttgaattctacgttgttgataactggctcagtcaatggcgtccaggagattgggttggtaacaaaaagcatggtgatttcactattgatggtgctaaatatactgtttatgaaaacactcgttacggtccatctattgatggtgacactaacttcaagcaatacttcagtattcgtcaacaaccacgtgactgtggtacaattgatattactgctcacttccaacaatgggaaaaacttggtatgaccatgggtaaaatgca

SEQ ID NO: 25324 - DNA, 300 bp, Anaeromyces robustus
  GLYCOSYL TRANSFERASE-RELATED
ttatgtaggtatttacggttggactagaaacccacttgttgaattctacgttgttgataattggcttagtcaatatcgtccaggtgattgggttggtaataaaaaacatggtgatttcactattgatggtgctaaatatactgtttatgaaaatactcgttatggtccatctattgatggtaatacaaacttcaaacaatactttagtattcgtcaacaagctcgtgattgtggtactattgatattactgcccactttgaacaatgggaaaaacttggtatgactatgggtaaaatgca

SEQ ID NO: 25325 - DNA, 300 bp, Anaeromyces robustus
  GLYCOSYL TRANSFERASE-RELATED
ttatgtaggtatttacggttggactagaaacccacttgttgaattctacgttgttgataattggcttagtcaatatcgtccaggtgattgggttggtaataaaaaacatggtgaatttactattgatggtgctaaatatactgtttatgaaaatactcgttatggtccatctattgatggtgatacaagtttcaaacaatactttagtattcgtcaacaagctcgtgattgtggtactattgatattactgcccactttgaacaatgggaaaaacttggtatgactatgggtaaaatgca

SEQ ID NO: 25326 - DNA, 318 bp, Anaeromyces robustus
  GLYCOSYL TRANSFERASE-RELATED
ttatgttggtatttatggttggacaagaaatccacttgttgaattttatattgtagataattggctcagtccaagtcgtccaggggattgggttggtaatagaaaacatggtgatttcactattgatggtgctaaatatactgtttatgaaaatactcgtaatggtccttctattgatggtaatactaatttcaaacaatatttcagtattcgtcaacaagctcgtgattgtggtactattgatattaatgctcactttgaacaatgggaaaaattaggtatgcaaatgggtaaaatgcatgaagctaaaattttagg

SEQ ID NO: 25327 - DNA, 504 bp, Anaeromyces robustus; identical to SEQ ID NO: 19933
  GLYCOSYL TRANSFERASE-RELATED

SEQ ID NO: 25328 - DNA, 498 bp, Piromyces finnis
  GLYCOSYL TRANSFERASE-RELATED
ctatgtaggtatttacggttggactagaagtccacttgttgaattctacgttgttgataactggctcagtcaatggcgtccaggagattgggttggtaacaagaaacatggtgattttgttattgatggagctacttacactgtttatgaaaacactcgttacggtccatctattgatggtgatactcaattcaaacaatacttcagtattcgtcaacaagctcgtgattgtggtactattgatattacagctcacttccaacaatgggctaaacttggtatgaatcttggtaagatgcatgaagctaaggttttaggtgaagctggtagtactggttctggtactagtggtactgctgatttcccatatgctaaggtttacattggtgatggtaattctggtaattctaattctaacactggtaactcttttggtggtaatactggtaatactcaaactggaaacaaccaaagtagtaacaaccaaagtaattcatc

SEQ ID NO: 25329 - DNA, 498 bp, Piromyces finnis
  GLYCOSYL TRANSFERASE-RELATED
ctatgtaggtatttacggttggactagaagtccacttgttgaattctacgttgttgataactggctcagtcaatggcgtccaggagattgggttggtaacaagaaacatggtgattttgttattgatggagctacttacactgtttatgaaaacactcgttacggtccatctattgatggtgatactcaattcaaacaatacttcagtattcgtcaacaagctcgtgactgtggtactattgatattactgctcacttccaacaatgggaaaagcttggtatgaagcttggtaagatgcatgaagctaaggttttaggtgaagctggtagtactggttctggtactagtggtactgctgatttcccatatgctaaggtttacattggtgatggtaattctggtaattctaattctaacactggtaactcttttggtggtaatactggtaatactcaaactggaaacaaccaaagtagtaacaaccaaagtaattcatc

SEQ ID NO: 25330 - DNA, 498 bp, Piromyces finnis; identical to SEQ ID NO: 25329
  GLYCOSYL TRANSFERASE-RELATED

SEQ ID NO: 25331 - DNA, 498 bp, Piromyces finnis
  GLYCOSYL TRANSFERASE-RELATED
ttacgttggtatttacggttggaccagaaacccacttgttgaattctacgttgttgataactggctcagtcaatggcgtccaggtgattgggttggtaacaagaagcatggtgatttcactattgatggtgctcaatacactgtttacgaaaacactcgttacggtccatctattgatggtgatactcaattcaaacaatacttcagtattcgtcaacaagctcgtgattgtggtactattgatattacagctcacttccaacaatgggaaaagcttggtatgaagcttggtaagatgcatgaagctaaggttttaggtgaagctggtagtactggttctggtactagtggtactgctgatttcccatatgctaaggtttacattggtgatggtaattctggtaattctaattctaacactggtaactcttttggtggtaatactggtaatactcaaactggaaacaaccaaagtagtaacaaccaaagtaattcatc

SEQ ID NO: 25332 - DNA, 33 bp, Neocallimastix californiae
  GLYCOSYL_HYDROL_F10
ccttgaagttcacattactgaattagatgtcag

SEQ ID NO: 25333 - DNA, 33 bp, Neocallimastix californiae
  GLYCOSYL_HYDROL_F10
cgttgaagttcatattactgaaattgatgttaa

SEQ ID NO: 25334 - DNA, 33 bp, Neocallimastix californiae
  GLYCOSYL_HYDROL_F10
ccttgaggttcacattaccgaaattgatgtcag

SEQ ID NO: 25335 - DNA, 33 bp, Neocallimastix californiae
  GLYCOSYL_HYDROL_F10
tgttgaagttcacatcactgaattagatgtcag

SEQ ID NO: 25336 - DNA, 33 bp, Neocallimastix californiae
  GLYCOSYL_HYDROL_F10
tgttgaagttcatatcactgaattagatgtcag

SEQ ID NO: 25337 - DNA, 33 bp, Neocallimastix californiae
  GLYCOSYL_HYDROL_F10
agttgaagttcatatcactgaattagatgtcag

SEQ ID NO: 25338 - DNA, 33 bp, Neocallimastix californiae
  GLYCOSYL_HYDROL_F10
acttgaagttcacattactgaacttgatgttaa

SEQ ID NO: 25339 - DNA, 33 bp, Neocallimastix californiae
  GLYCOSYL_HYDROL_F10
tattgaagttcatattactgaactcgatgttaa

SEQ ID NO: 25340 - DNA, 33 bp, Neocallimastix californiae
  GLYCOSYL_HYDROL_F10
tgttgaagttcatgttactgaaattgatgttaa

SEQ ID NO: 25341 - DNA, 33 bp, Neocallimastix californiae
  GLYCOSYL_HYDROL_F10
agttgaagttcacgttactgaaattgacgtaac

SEQ ID NO: 25342 - DNA, 33 bp, Neocallimastix californiae
  GLYCOSYL_HYDROL_F10
tcttgaagttcatattactgaacttgatgttaa

SEQ ID NO: 25343 - DNA, 33 bp, Neocallimastix californiae
  GLYCOSYL_HYDROL_F10
tgttgaagttcatattactgaattagatgtcag

SEQ ID NO: 25344 - DNA, 33 bp, Neocallimastix californiae
  GLYCOSYL_HYDROL_F10
tgttgaagttcacattactgaaattgatgtcag

SEQ ID NO: 25345 - DNA, 33 bp, Anaeromyces robustus; identical to SEQ ID NO: 25344
  GLYCOSYL_HYDROL_F10

SEQ ID NO: 25346 - DNA, 33 bp, Anaeromyces robustus; identical to SEQ ID NO: 25342
  GLYCOSYL_HYDROL_F10

SEQ ID NO: 25347 - DNA, 33 bp, Anaeromyces robustus
  GLYCOSYL_HYDROL_F10
tgttgaagttcatattacagaattagatgttag

SEQ ID NO: 25348 - DNA, 33 bp, Piromyces finnis
  GLYCOSYL_HYDROL_F10
tgttgaagttcatgttactgaaattgatgtcag

SEQ ID NO: 25349 - DNA, 33 bp, Piromyces finnis
  GLYCOSYL_HYDROL_F10
tcttgaagttcacattactgaacttgatgttaa

SEQ ID NO: 25350 - DNA, 33 bp, Piromyces finnis; identical to SEQ ID NO: 25349
  GLYCOSYL_HYDROL_F10

SEQ ID NO: 25351 - DNA, 33 bp, Neocallimastix californiae; identical to SEQ ID NO: 23553
  GLYCOSYL_HYDROL_F11_1

SEQ ID NO: 25352 - DNA, 33 bp, Neocallimastix californiae; identical to SEQ ID NO: 23553
  GLYCOSYL_HYDROL_F11_1

SEQ ID NO: 25353 - DNA, 33 bp, Neocallimastix californiae; identical to SEQ ID NO: 23563
  GLYCOSYL_HYDROL_F11_1

SEQ ID NO: 25354 - DNA, 33 bp, Neocallimastix californiae; identical to SEQ ID NO: 23568
  GLYCOSYL_HYDROL_F11_1

SEQ ID NO: 25355 - DNA, 33 bp, Neocallimastix californiae; identical to SEQ ID NO: 23568
  GLYCOSYL_HYDROL_F11_1

SEQ ID NO: 25356 - DNA, 33 bp, Neocallimastix californiae; identical to SEQ ID NO: 23563
  GLYCOSYL_HYDROL_F11_1

SEQ ID NO: 25357 - DNA, 33 bp, Neocallimastix californiae; identical to SEQ ID NO: 23576
  GLYCOSYL_HYDROL_F11_1

SEQ ID NO: 25358 - DNA, 33 bp, Neocallimastix californiae; identical to SEQ ID NO: 23576
  GLYCOSYL_HYDROL_F11_1

SEQ ID NO: 25359 - DNA, 33 bp, Neocallimastix californiae
  GLYCOSYL_HYDROL_F11_1
acttgttgaattctatgttgttgataactggct

SEQ ID NO: 25360 - DNA, 33 bp, Neocallimastix californiae; identical to SEQ ID NO: 23580
  GLYCOSYL_HYDROL_F11_1

SEQ ID NO: 25361 - DNA, 33 bp, Neocallimastix californiae; identical to SEQ ID NO: 23580
  GLYCOSYL_HYDROL_F11_1

SEQ ID NO: 25362 - DNA, 33 bp, Neocallimastix californiae
  GLYCOSYL_HYDROL_F11_1
acttgttgaattctatgttgtagataactggct

SEQ ID NO: 25363 - DNA, 33 bp, Neocallimastix californiae; identical to SEQ ID NO: 23587
  GLYCOSYL_HYDROL_F11_1

SEQ ID NO: 25364 - DNA, 33 bp, Neocallimastix californiae; identical to SEQ ID NO: 23587
  GLYCOSYL_HYDROL_F11_1

SEQ ID NO: 25365 - DNA, 33 bp, Neocallimastix californiae; identical to SEQ ID NO: 23576
  GLYCOSYL_HYDROL_F11_1

SEQ ID NO: 25366 - DNA, 33 bp, Neocallimastix californiae; identical to SEQ ID NO: 23595
  GLYCOSYL_HYDROL_F11_1

SEQ ID NO: 25367 - DNA, 33 bp, Neocallimastix californiae; identical to SEQ ID NO: 23600
  GLYCOSYL_HYDROL_F11_1

SEQ ID NO: 25368 - DNA, 33 bp, Neocallimastix californiae
  GLYCOSYL_HYDROL_F11_1
acttgttgaatattacgttgtagataattggct

SEQ ID NO: 25369 - DNA, 33 bp, Anaeromyces robustus; identical to SEQ ID NO: 23595
  GLYCOSYL_HYDROL_F11_1

SEQ ID NO: 25370 - DNA, 33 bp, Anaeromyces robustus
  GLYCOSYL_HYDROL_F11_1
acttgttgaattctatgttgtcgataattggct

SEQ ID NO: 25371 - DNA, 33 bp, Anaeromyces robustus; identical to SEQ ID NO: 23563
  GLYCOSYL_HYDROL_F11_1

SEQ ID NO: 25372 - DNA, 33 bp, Anaeromyces robustus; identical to SEQ ID NO: 23622
  GLYCOSYL_HYDROL_F11_1

SEQ ID NO: 25373 - DNA, 33 bp, Anaeromyces robustus; identical to SEQ ID NO: 23622
  GLYCOSYL_HYDROL_F11_1

SEQ ID NO: 25374 - DNA, 33 bp, Anaeromyces robustus; identical to SEQ ID NO: 23632
  GLYCOSYL_HYDROL_F11_1

SEQ ID NO: 25375 - DNA, 33 bp, Anaeromyces robustus; identical to SEQ ID NO: 23640
  GLYCOSYL_HYDROL_F11_1

SEQ ID NO: 25376 - DNA, 33 bp, Anaeromyces robustus; identical to SEQ ID NO: 23640
  GLYCOSYL_HYDROL_F11_1

SEQ ID NO: 25377 - DNA, 33 bp, Anaeromyces robustus; identical to SEQ ID NO: 23640
  GLYCOSYL_HYDROL_F11_1

SEQ ID NO: 25378 - DNA, 33 bp, Piromyces finnis; identical to SEQ ID NO: 23563
  GLYCOSYL_HYDROL_F11_1

SEQ ID NO: 25379 - DNA, 33 bp, Piromyces finnis; identical to SEQ ID NO: 23563
  GLYCOSYL_HYDROL_F11_1

SEQ ID NO: 25380 - DNA, 33 bp, Piromyces finnis; identical to SEQ ID NO: 23563
  GLYCOSYL_HYDROL_F11_1

SEQ ID NO: 25381 - DNA, 33 bp, Piromyces finnis; identical to SEQ ID NO: 23563
  GLYCOSYL_HYDROL_F11_1

SEQ ID NO: 25382 - DNA, 36 bp, Neocallimastix californiae
  GLYCOSYL_HYDROL_F11_2
tctcgttgaagctggtggtggttctggttcatttga

SEQ ID NO: 25383 - DNA, 36 bp, Anaeromyces robustus; identical to SEQ ID NO: 25382
  GLYCOSYL_HYDROL_F11_2

SEQ ID NO: 25384 - DNA, 54 bp, Neocallimastix californiae
  GLYCOSYL_HYDROL_F3
tttaaaggaaaaaatgaatttccaaggttttgttatgtctgattggtgggctat

SEQ ID NO: 25385 - DNA, 36 bp, Neocallimastix californiae
  GLYCOSYL_HYDROL_F45
tactcgttactgggattgttgtcttgcatcatgttc

SEQ ID NO: 25386 - DNA, 36 bp, Neocallimastix californiae
  GLYCOSYL_HYDROL_F45
taccagatactgggattgttgtaaaccatcatgtgc

SEQ ID NO: 25387 - DNA, 36 bp, Neocallimastix californiae
  GLYCOSYL_HYDROL_F45
cactcgttactgggattgctgtaagccatcttgttc

SEQ ID NO: 25388 - DNA, 36 bp, Neocallimastix californiae
  GLYCOSYL_HYDROL_F45
cactcgttactatgattgttgtaaaccatcttgttc

SEQ ID NO: 25389 - DNA, 36 bp, Neocallimastix californiae
  GLYCOSYL_HYDROL_F45
aactcgttactacgattgttgtaaaccatcttgttc

SEQ ID NO: 25390 - DNA, 36 bp, Neocallimastix californiae
  GLYCOSYL_HYDROL_F45
tacacgttactgggattgttgcaaaccttcatgtgc

SEQ ID NO: 25391 - DNA, 36 bp, Neocallimastix californiae
  GLYCOSYL_HYDROL_F45
tactcgttactacgattgttgtaagccatcttgttc

SEQ ID NO: 25392 - DNA, 36 bp, Neocallimastix californiae
  GLYCOSYL_HYDROL_F45
cactcgttattgggattgttgtcttgcttcttgttc

SEQ ID NO: 25393 - DNA, 36 bp, Neocallimastix californiae
  GLYCOSYL_HYDROL_F45
tactcgttactgggattgttgtaagccatcttgttc

SEQ ID NO: 25394 - DNA, 36 bp, Neocallimastix californiae
  GLYCOSYL_HYDROL_F45
aactcgttactgggattgttgtcttgcttcttgttc

SEQ ID NO: 25395 - DNA, 36 bp, Neocallimastix californiae
  GLYCOSYL_HYDROL_F45
taccagatattgggattgttgtaaaccatcttgtgc

SEQ ID NO: 25396 - DNA, 36 bp, Neocallimastix californiae
  GLYCOSYL_HYDROL_F45
tactcgttactgggattgttgtcttgcttcctgttc

SEQ ID NO: 25397 - DNA, 36 bp, Anaeromyces robustus; identical to SEQ ID NO: 25396
  GLYCOSYL_HYDROL_F45

SEQ ID NO: 25398 - DNA, 36 bp, Anaeromyces robustus
  GLYCOSYL_HYDROL_F45
cactcgttattgggattgttgtaaaccatcttgtgc

SEQ ID NO: 25399 - DNA, 36 bp, Anaeromyces robustus
  GLYCOSYL_HYDROL_F45
cactagatactgggattgttgtaaaccatcctgtgc

SEQ ID NO: 25400 - DNA, 36 bp, Anaeromyces robustus
  GLYCOSYL_HYDROL_F45
tactcgttactgggattgttgtaaaccatcttgttc

SEQ ID NO: 25401 - DNA, 36 bp, Anaeromyces robustus
  GLYCOSYL_HYDROL_F45
cactcgttattatgattgttgtaaaccatcttgttc

SEQ ID NO: 25402 - DNA, 36 bp, Anaeromyces robustus; identical to SEQ ID NO: 25398
  GLYCOSYL_HYDROL_F45

SEQ ID NO: 25403 - DNA, 36 bp, Piromyces finnis; identical to SEQ ID NO: 25391
  GLYCOSYL_HYDROL_F45

SEQ ID NO: 25404 - DNA, 36 bp, Piromyces finnis
  GLYCOSYL_HYDROL_F45
cactcgttactacgattgttgtaagccatcttgttc

SEQ ID NO: 25405 - DNA, 30 bp, Neocallimastix californiae
  GLYCOSYL_HYDROL_F5
aattttcgaaggtatgaatgaaccaagaaa

SEQ ID NO: 25406 - DNA, 30 bp, Neocallimastix californiae
  GLYCOSYL_HYDROL_F5
ttggtttggtttagtaaatgaaccacatga

SEQ ID NO: 25407 - DNA, 30 bp, Neocallimastix californiae
  GLYCOSYL_HYDROL_F5
tggagctgatcttcacaatgaaccacacgg

SEQ ID NO: 25408 - DNA, 30 bp, Neocallimastix californiae
  GLYCOSYL_HYDROL_F5
tggtgctgatcttcacaatgaaccacacgg

SEQ ID NO: 25409 - DNA, 30 bp, Neocallimastix californiae
  GLYCOSYL_HYDROL_F5
aattttcgaaggtatgaacgaaccaagaaa

SEQ ID NO: 25410 - DNA, 30 bp, Neocallimastix californiae
  GLYCOSYL_HYDROL_F5
tggtgctgatcttcacaatgaaccacatgg

SEQ ID NO: 25411 - DNA, 30 bp, Neocallimastix californiae
  GLYCOSYL_HYDROL_F5
atggtttgatttagttaatgaaccccatga

SEQ ID NO: 25412 - DNA, 30 bp, Neocallimastix californiae
  GLYCOSYL_HYDROL_F5
atggtttggtttagttaatgaaccacatga

SEQ ID NO: 25413 - DNA, 30 bp, Neocallimastix californiae; identical to SEQ ID NO: 25410
  GLYCOSYL_HYDROL_F5

SEQ ID NO: 25414 - DNA, 30 bp, Neocallimastix californiae; identical to SEQ ID NO: 25410
  GLYCOSYL_HYDROL_F5

SEQ ID NO: 25415 - DNA, 30 bp, Neocallimastix californiae
  GLYCOSYL_HYDROL_F5
tggtgctgatttacataatgaacctcatga

SEQ ID NO: 25416 - DNA, 30 bp, Neocallimastix californiae
  GLYCOSYL_HYDROL_F5
ttggtttggattagtgaatgaaccccatga

SEQ ID NO: 25417 - DNA, 30 bp, Neocallimastix californiae
  GLYCOSYL_HYDROL_F5
cggtgctgatattcataatgaaccccatgg

SEQ ID NO: 25418 - DNA, 30 bp, Anaeromyces robustus; identical to SEQ ID NO: 25410
  GLYCOSYL_HYDROL_F5

SEQ ID NO: 25419 - DNA, 30 bp, Anaeromyces robustus
  GLYCOSYL_HYDROL_F5
tggtgctgatcttcataatgaaccacacgg

SEQ ID NO: 25420 - DNA, 30 bp, Anaeromyces robustus
  GLYCOSYL_HYDROL_F5
ttggtttggtttagttaatgaaccacatga

SEQ ID NO: 25421 - DNA, 30 bp, Anaeromyces robustus
  GLYCOSYL_HYDROL_F5
atggtttggtttagttaatgaaccccatga

SEQ ID NO: 25422 - DNA, 30 bp, Anaeromyces robustus
  GLYCOSYL_HYDROL_F5
tggtgctgatattcataatgaacctcatgg

SEQ ID NO: 25423 - DNA, 30 bp, Piromyces finnis
  GLYCOSYL_HYDROL_F5
tggtgctgatcttcacaacgaaccacacag

SEQ ID NO: 25424 - DNA, 30 bp, Piromyces finnis
  GLYCOSYL_HYDROL_F5
aatcttcgaaggtcaaaacgaaccaagaaa

SEQ ID NO: 25425 - DNA, 30 bp, Piromyces finnis; identical to SEQ ID NO: 25424
  GLYCOSYL_HYDROL_F5

SEQ ID NO: 25426 - DNA, 30 bp, Piromyces finnis
  GLYCOSYL_HYDROL_F5
ttggttcggtttagttaatgaaccacacga

SEQ ID NO: 25427 - DNA, 30 bp, Piromyces finnis; identical to SEQ ID NO: 25426
  GLYCOSYL_HYDROL_F5

SEQ ID NO: 25428 - DNA, 30 bp, Neocallimastix californiae
  GLYCOSYL_HYDROL_F6_2
tcttattgttgaaccagattcacttgctaa

SEQ ID NO: 25429 - DNA, 30 bp, Neocallimastix californiae
  GLYCOSYL_HYDROL_F6_2
tgctattattgaaccagatgcccttggtaa

SEQ ID NO: 25430 - DNA, 30 bp, Neocallimastix californiae
  GLYCOSYL_HYDROL_F6_2
tcttattgttgaacctgattcacttgctaa

SEQ ID NO: 25431 - DNA, 30 bp, Neocallimastix californiae
  GLYCOSYL_HYDROL_F6_2
tcttattgttgaacccgattcacttgctaa

SEQ ID NO: 25432 - DNA, 30 bp, Neocallimastix californiae
  GLYCOSYL_HYDROL_F6_2
tcttgttattgaaccagattcccttgctaa

SEQ ID NO: 25433 - DNA, 30 bp, Neocallimastix californiae
  GLYCOSYL_HYDROL_F6_2
tcttattgttgaaccagattctcttgctaa

SEQ ID NO: 25434 - DNA, 30 bp, Neocallimastix californiae; identical to SEQ ID NO: 25433
  GLYCOSYL_HYDROL_F6_2

SEQ ID NO: 25435 - DNA, 30 bp, Neocallimastix californiae; identical to SEQ ID NO: 25431
  GLYCOSYL_HYDROL_F6_2

SEQ ID NO: 25436 - DNA, 30 bp, Neocallimastix californiae; identical to SEQ ID NO: 25432
  GLYCOSYL_HYDROL_F6_2

SEQ ID NO: 25437 - DNA, 30 bp, Neocallimastix californiae
  GLYCOSYL_HYDROL_F6_2
tgcaattattgaaccagatgcccttggtaa

SEQ ID NO: 25438 - DNA, 30 bp, Neocallimastix californiae
  GLYCOSYL_HYDROL_F6_2
tcttattgttgaaccagattcattggctaa

SEQ ID NO: 25439 - DNA, 30 bp, Neocallimastix californiae
  GLYCOSYL_HYDROL_F6_2
tcttattattgaaccagattcacttgctaa

SEQ ID NO: 25440 - DNA, 30 bp, Neocallimastix californiae; identical to SEQ ID NO: 25439
  GLYCOSYL_HYDROL_F6_2

SEQ ID NO: 25441 - DNA, 30 bp, Neocallimastix californiae; identical to SEQ ID NO: 25439
  GLYCOSYL_HYDROL_F6_2

SEQ ID NO: 25442 - DNA, 30 bp, Neocallimastix californiae; identical to SEQ ID NO: 25439
  GLYCOSYL_HYDROL_F6_2

SEQ ID NO: 25443 - DNA, 30 bp, Neocallimastix californiae; identical to SEQ ID NO: 25439
  GLYCOSYL_HYDROL_F6_2

SEQ ID NO: 25444 - DNA, 30 bp, Neocallimastix californiae
  GLYCOSYL_HYDROL_F6_2
tcttattattgaaccagattcacttgcaaa

SEQ ID NO: 25445 - DNA, 30 bp, Neocallimastix californiae; identical to SEQ ID NO: 25429
  GLYCOSYL_HYDROL_F6_2

SEQ ID NO: 25446 - DNA, 30 bp, Anaeromyces robustus; identical to SEQ ID NO: 25439
  GLYCOSYL_HYDROL_F6_2

SEQ ID NO: 25447 - DNA, 30 bp, Anaeromyces robustus; identical to SEQ ID NO: 25429
  GLYCOSYL_HYDROL_F6_2

SEQ ID NO: 25448 - DNA, 30 bp, Anaeromyces robustus
  GLYCOSYL_HYDROL_F6_2
ccttattattgaaccagattcacttgctaa

SEQ ID NO: 25449 - DNA, 30 bp, Piromyces finnis
  GLYCOSYL_HYDROL_F6_2
tcttattattgaaccagattcccttgctaa

SEQ ID NO: 25450 - DNA, 30 bp, Piromyces finnis; identical to SEQ ID NO: 25449
  GLYCOSYL_HYDROL_F6_2

SEQ ID NO: 25451 - DNA, 30 bp, Piromyces finnis; identical to SEQ ID NO: 25449
  GLYCOSYL_HYDROL_F6_2

SEQ ID NO: 25452 - DNA, 30 bp, Piromyces finnis; identical to SEQ ID NO: 25449
  GLYCOSYL_HYDROL_F6_2

SEQ ID NO: 25453 - DNA, 30 bp, Piromyces finnis; identical to SEQ ID NO: 25449
  GLYCOSYL_HYDROL_F6_2

SEQ ID NO: 25454 - DNA, 30 bp, Piromyces finnis; identical to SEQ ID NO: 25449
  GLYCOSYL_HYDROL_F6_2

SEQ ID NO: 25455 - DNA, 30 bp, Piromyces finnis; identical to SEQ ID NO: 25449
  GLYCOSYL_HYDROL_F6_2

SEQ ID NO: 25456 - DNA, 30 bp, Piromyces finnis; identical to SEQ ID NO: 25449
  GLYCOSYL_HYDROL_F6_2

SEQ ID NO: 25457 - DNA, 30 bp, Piromyces finnis; identical to SEQ ID NO: 25449
  GLYCOSYL_HYDROL_F6_2

SEQ ID NO: 25458 - DNA, 30 bp, Piromyces finnis; identical to SEQ ID NO: 25449
  GLYCOSYL_HYDROL_F6_2

SEQ ID NO: 25459 - DNA, 30 bp, Piromyces finnis; identical to SEQ ID NO: 25449
  GLYCOSYL_HYDROL_F6_2

SEQ ID NO: 25460 - DNA, 30 bp, Piromyces finnis; identical to SEQ ID NO: 25449
  GLYCOSYL_HYDROL_F6_2

SEQ ID NO: 25461 - DNA, 30 bp, Piromyces finnis; identical to SEQ ID NO: 25449
  GLYCOSYL_HYDROL_F6_2

SEQ ID NO: 25462 - DNA, 30 bp, Piromyces finnis; identical to SEQ ID NO: 25449
  GLYCOSYL_HYDROL_F6_2

SEQ ID NO: 25463 - DNA, 30 bp, Piromyces finnis; identical to SEQ ID NO: 25449
  GLYCOSYL_HYDROL_F6_2

SEQ ID NO: 25464 - DNA, 30 bp, Piromyces finnis; identical to SEQ ID NO: 25449
  GLYCOSYL_HYDROL_F6_2

SEQ ID NO: 25465 - DNA, 30 bp, Piromyces finnis; identical to SEQ ID NO: 25449
  GLYCOSYL_HYDROL_F6_2

SEQ ID NO: 25466 - DNA, 30 bp, Piromyces finnis; identical to SEQ ID NO: 25449
  GLYCOSYL_HYDROL_F6_2

SEQ ID NO: 25467 - DNA, 30 bp, Piromyces finnis; identical to SEQ ID NO: 25449
  GLYCOSYL_HYDROL_F6_2

SEQ ID NO: 25468 - DNA, 30 bp, Piromyces finnis; identical to SEQ ID NO: 25449
  GLYCOSYL_HYDROL_F6_2

SEQ ID NO: 25469 - DNA, 30 bp, Piromyces finnis; identical to SEQ ID NO: 25449
  GLYCOSYL_HYDROL_F6_2

SEQ ID NO: 25470 - DNA, 30 bp, Piromyces finnis; identical to SEQ ID NO: 25449
  GLYCOSYL_HYDROL_F6_2

SEQ ID NO: 25471 - DNA, 30 bp, Piromyces finnis; identical to SEQ ID NO: 25449
  GLYCOSYL_HYDROL_F6_2

SEQ ID NO: 25472 - DNA, 30 bp, Piromyces finnis; identical to SEQ ID NO: 25449
  GLYCOSYL_HYDROL_F6_2

SEQ ID NO: 25473 - DNA, 30 bp, Piromyces finnis; identical to SEQ ID NO: 25449
  GLYCOSYL_HYDROL_F6_2

SEQ ID NO: 25474 - DNA, 30 bp, Piromyces finnis; identical to SEQ ID NO: 25449
  GLYCOSYL_HYDROL_F6_2

SEQ ID NO: 25475 - DNA, 30 bp, Piromyces finnis; identical to SEQ ID NO: 25449
  GLYCOSYL_HYDROL_F6_2

SEQ ID NO: 25476 - DNA, 30 bp, Piromyces finnis; identical to SEQ ID NO: 25449
  GLYCOSYL_HYDROL_F6_2

SEQ ID NO: 25477 - DNA, 30 bp, Piromyces finnis; identical to SEQ ID NO: 25449
  GLYCOSYL_HYDROL_F6_2

SEQ ID NO: 25478 - DNA, 30 bp, Piromyces finnis; identical to SEQ ID NO: 25449
  GLYCOSYL_HYDROL_F6_2

SEQ ID NO: 25479 - DNA, 57 bp, Neocallimastix californiae
  GLYCOSYL_HYDROL_F9_2
cgttgatagccgtaaggactatcaaatgagtgaagttgctcttgattacaatgccgc

SEQ ID NO: 25480 - DNA, 57 bp, Neocallimastix californiae
  GLYCOSYL_HYDROL_F9_2
cactgataccagaaagaactatgaaatgaatgaagttgctcttgattacaatgctgc

SEQ ID NO: 25481 - DNA, 57 bp, Neocallimastix californiae
  GLYCOSYL_HYDROL_F9_2
ctctgataccagaaaggattatgaaatgaacgaagttgctcttgattacaatgctgc

SEQ ID NO: 25482 - DNA, 57 bp, Neocallimastix californiae
  GLYCOSYL_HYDROL_F9_2
cactgatgatcgtactaactataactctaatgaagttgctttagattataatgccgc

SEQ ID NO: 25483 - DNA, 57 bp, Neocallimastix californiae
  GLYCOSYL_HYDROL_F9_2
ggatgatgatagaaataattatattactaatgaagtttcatgtgattataatgctgg

SEQ ID NO: 25484 - DNA, 57 bp, Neocallimastix californiae
  GLYCOSYL_HYDROL_F9_2
cgttgatagtcgtaaggattatcaaatgagtgaagttgctcttgattataatgcagc

SEQ ID NO: 25485 - DNA, 57 bp, Neocallimastix californiae
  GLYCOSYL_HYDROL_F9_2
ggatgatgatcgtaacaattatgttactaatgaagttgcttgtgattataatgctgg

SEQ ID NO: 25486 - DNA, 57 bp, Neocallimastix californiae
  GLYCOSYL_HYDROL_F9_2
caaagatattcgtgaggattatcaaaaaaatgaagtcgctttagattataatgctgc

SEQ ID NO: 25487 - DNA, 57 bp, Neocallimastix californiae
  GLYCOSYL_HYDROL_F9_2
caaggatgctcgtgataactatgaaatgaacgaagttgctttagattacaatgctgc

SEQ ID NO: 25488 - DNA, 57 bp, Neocallimastix californiae; identical to SEQ ID NO: 25487
  GLYCOSYL_HYDROL_F9_2

SEQ ID NO: 25489 - DNA, 57 bp, Neocallimastix californiae
  GLYCOSYL_HYDROL_F9_2
taccgattctagaaagaattatcaaatgaatgaagttgctcttgattataatgctgg

SEQ ID NO: 25490 - DNA, 57 bp, Anaeromyces robustus; identical to SEQ ID NO: 25489
  GLYCOSYL_HYDROL_F9_2

SEQ ID NO: 25491 - DNA, 57 bp, Anaeromyces robustus
  GLYCOSYL_HYDROL_F9_2
caaggatgatcgtaccaattataattctaatgaagttgctttagattataatgctgc

SEQ ID NO: 25492 - DNA, 57 bp, Anaeromyces robustus
  GLYCOSYL_HYDROL_F9_2
taaggatactcgtaataattatgaaatgaatgaagtagctttagattacaatgctgc

SEQ ID NO: 25493 - DNA, 57 bp, Anaeromyces robustus
  GLYCOSYL_HYDROL_F9_2
ttctgatactagaaagaattatgaaatgaatgaagttgctcttgattacaatgctgc

SEQ ID NO: 25494 - DNA, 57 bp, Anaeromyces robustus
  GLYCOSYL_HYDROL_F9_2
taccgacacaagaaagaattatgaaatgaatgaagttgcccttgattataatgctgc

SEQ ID NO: 25495 - DNA, 57 bp, Anaeromyces robustus; identical to SEQ ID NO: 25491
  GLYCOSYL_HYDROL_F9_2

SEQ ID NO: 25496 - DNA, 57 bp, Anaeromyces robustus
  GLYCOSYL_HYDROL_F9_2
ggatgatgatagaaacaactatattactaatgaagtttcttgtgattataatgctgg

SEQ ID NO: 25497 - DNA, 57 bp, Piromyces finnis
  GLYCOSYL_HYDROL_F9_2
cactgattctagaaagaattatgaaatgaacgaagttgcacttgattacaatgctgc

SEQ ID NO: 25498 - DNA, 57 bp, Piromyces finnis
  GLYCOSYL_HYDROL_F9_2
cattgatactcgtagtaactttagaaccaatgaagtagctcttgattacaatgctgc

SEQ ID NO: 25499 - DNA, 57 bp, Piromyces finnis; identical to SEQ ID NO: 25497
  GLYCOSYL_HYDROL_F9_2

SEQ ID NO: 25500 - DNA, 57 bp, Piromyces finnis; identical to SEQ ID NO: 25497
  GLYCOSYL_HYDROL_F9_2

SEQ ID NO: 25501 - DNA, 57 bp, Piromyces finnis; identical to SEQ ID NO: 25498
  GLYCOSYL_HYDROL_F9_2

SEQ ID NO: 25502 - DNA, 57 bp, Piromyces finnis; identical to SEQ ID NO: 25497
  GLYCOSYL_HYDROL_F9_2

SEQ ID NO: 25503 - DNA, 57 bp, Piromyces finnis
  GLYCOSYL_HYDROL_F9_2
caaggatgctcgtaacaactatgaaatgaacgaagtcgccttagattacaatgctgc

SEQ ID NO: 25504 - DNA, 57 bp, Piromyces finnis
  GLYCOSYL_HYDROL_F9_2
cgaagataccagaaagaattatgaaatgaatgaagttgctcttgattataatgctgc

SEQ ID NO: 25505 - DNA, 57 bp, Piromyces finnis
  GLYCOSYL_HYDROL_F9_2
tactgatgatcgtaccaactataattccaatgaagttgctttagattataatgctgc

SEQ ID NO: 25506 - DNA, 57 bp, Piromyces finnis
  GLYCOSYL_HYDROL_F9_2
cactgatgaccgtaccaattacaactccaatgaagtcgctttagattataacgctgc

SEQ ID NO: 25507 - DNA, 531 bp, Neocallimastix californiae
  GroES-like
tactttcaaggcttgggctgctcttaacgctaaagaaaagttacaaccatacgaatacactccagaaccattagctgatgaccaaattgaagttaaggttactcataatggtttatgtcacagtgatattcacatgaaggataacgactggggaaattcttcttatccattcattccaggtcatgaagttattggtaatgttgttgccttaggtgctaatgctgaaaaactttctggtcttaaggttggtgacagagttggttatggttggattcgtgatagttgtggtttctgtgaatgttgtattgaaggtcaagaaaatctttgtgaaaagggttatgaaggtactattgttggtcatcatggtggtttccaagatcgtattagaatgccagctaaatttgcttttaagattccagaaaagcttccaagtgaatatgctgctcctttaatgtgtgctggtgctacagtttataatccacttcgtttattcattgaaaaaccaaatgttaaagttggtgttattggtat

SEQ ID NO: 25508 - DNA, 480 bp, Neocallimastix californiae
  GroES-like
ggcttgggctgctcttaacgctaaagaaaagttacaaccatacgaatacactccagaaccattagctgatgaccaaattgaagttaaggttactcataatggtttatgtcacagtgatattcacatgaaggataacgactggggaaattcttcttatccattcattccaggtcatgaagttattggtaatgttgttgccttaggtgctaatgctgaaaaactttctggtcttaaggttggtgacagagttggttatggttggattcgtgatagttgtggtttctgtgaatgttgtattgaaggtcaagaaaatctttgtgaaaagggttatgaaggtactattgttggtcatcatggtggtttccaagatcgtattagaatgccagctaaatttgcttttaagattccagaaaagcttccaagtgaatatgctgctcctttaatgtgtgctggtgctacagtttataatccacttcgttt

SEQ ID NO: 25509 - DNA, 633 bp, Neocallimastix californiae
  GroES-like
gaaaggttatgctatggtcaaaattggtgaacctggttgggttgaaaaagaaaaacccaaatgtgggccaatggatgctatttgtaaaccattagccattgcggtatgtacttcggatgttcatactgtatgggaaggagctattggagatcgtcatgatatgattttaggtcatgaatgttgtgctgaagtagttgaagttggttctgaagtcaaagatttcaaaccaggggatagagttattgttccagctattactcctgattggaattctttagaagctcaagctggttattcgatgcattcacatggcatgcttgctggttggaaattctctaacattaaggatggggtattctctgaatatttccatgtcaatgatgctgatggtaatcttgctcatttaccttcctctattaatactgtagatgcttgtatgctttcagatatggttccaacaggttttcatgctgttgaacttgctgatattcaatttggtgatgttgttcttcaaattggtattggtccagttggtcttatgtctgttgctggtgcttctcttagaggtgcttcacgtattatttgtgttggaactcgtaaagtttgtcaagatgttgctagaaaatatggtgc

SEQ ID NO: 25510 - DNA, 546 bp, Neocallimastix californiae
  GroES-like
gaaaggttatgctatggtcaaaattggtgaacctggttgggttgaaaaagaaaaacccaaatgtgggccaatggatgctatttgtaaaccattagccattgcggtatgtacttcggatgttcatactgtatgggaaggagctattggagatcgtcatgatatgattttaggtcatgaatgttgtgctgaagtagttgaagttggttctgaagtcaaagatttcaaaccaggggatagagttattgttccagctattactcctgattggaattctttagaagctcaagctggttattcgatgcattcacatggcatgcttgctggttggaaattctctaacattaaggatggggtattctctgaatatttccatgtcaatgatgctgatggtaatcttgctcatttaccttcctctattaatactgtagatgcttgtatgctttcagatatggttccaacaggttttcatgctgttgaacttgctgatattcaatttggtgatgttgttcttcaaattggtattggtccagttggtcttatgtctgt

SEQ ID NO: 25511 - DNA, 465 bp, Neocallimastix californiae
  GroES-like
tttagaaaacgttagttgtgtcttaaaccacttcccaggtgaaggtatggttaaacttgatgacatgaaaattgttaagagcgtcgttccagaattaggtgaaaacgatgttttacttaagaacctttgctgttctgttgatccattcatgcgtggtcgtatgagaaagggtgttaaatcctacgttgcttccttcgaagaaggtaagccaatgccagtcttctctgttactcaagttgctaagattggttctgctgttactgacattaatgttggtgacaagtacatgtgcttcaacggtattgaaaagtacaccgttcttccacaacaagttattaagggtgaaggtgaaaagaatcttggtagtttcaacaagattgatccaaacaacccactcaaggactctttctaccttggtttattcggtatgccaggtatgactgcttgggctttcttcaacaaggc

SEQ ID NO: 25512 - DNA, 444 bp, Neocallimastix californiae
  GroES-like
cttaaaccacttcccaggtgaaggtatggttaaacttgatgacatgaaaattgttaagagcgtcgttccagaattaggtgaaaacgatgttttacttaagaacctttgctgttctgttgatccattcatgcgtggtcgtatgagaaagggtgttaaatcctacgttgcttccttcgaagaaggtaagccaatgccagtcttctctgttactcaagttgctaagattggttctgctgttactgacattaatgttggtgacaagtacatgtgcttcaacggtattgaaaagtacaccgttcttccacaacaagttattaagggtgaaggtgaaaagaatcttggtagtttcaacaagattgatccaaacaacccactcaaggactctttctaccttggtttattcggtatgccaggtatgactgcttgggctttcttcaacaaggc

SEQ ID NO: 25513 - DNA, 279 bp, Neocallimastix californiae
  GroES-like
ttcaaaagctatggtatgttcaaaatatggacaaccaaaagatgttttaagtttaaaagaattaaaaattccaaaaattagggataatgaagttttagtgaaatttttagcagctccaattaatccttctgatattaatcaaattgaaggtgtttatccaattaaaccaagatttagagaatatggtgcagtgggtggtaatgaaggtgtcgctgaagtagttgctgctggttctaaagttaaaaacttaactataggtgattgggttattccagattc

SEQ ID NO: 25514 - DNA, 492 bp, Neocallimastix californiae
  GroES-like
aaaagctatggtatgttcaaaatatggacaaccaaaagatgttttaagtttaaaagaattaaaaattccaaaaattagggataatgaagttttagtgaaatttttagcagctccaattaatccttctgatattaatcaaattgaaggtgtttatccaattaaaccaagatttagagaatatggtgcagtgggtggtaatgaaggtgtcgctgaagtagttgctgctggttctaaagttaaaaacttaactataggtgattgggttattccagattccaaagctttcggaacttggcaaactttcgctgctagttcagaaaatgaattacaaaaaattagtaaaaacggtatttctaagataagcgctgcaactatttctgttaatcctccaacagcttatagaatgttaaaggactttgttaacttaaaaaaaggtgatgttgttattcaaaacggagctaatagtgcagttggtcaatctgttattcaaat

SEQ ID NO: 25515 - DNA, 486 bp, Neocallimastix californiae
  GroES-like
tggagtatcacttgttgaaagaagagctttaagagatgatgatgttgaaattgatattaaatattgtggtatttgtcactcagatattatgattgtacaaattaatcaaccaggaaaaggtgttgttccaggtcatgaaattaccggtgttgtaaaatctgttggtaaggcagttacaaatttcaaagtaggtgatcatgttggtgtaggttgttttgttaactcctgtagtaactgtgaatactgtaaacgtggtgatgaacaattttgtgataagggtgtagttgttgtatttaatagtaaggattatgatggtgcaataacctatggtggttatactcaaactattatcgtcaaagataaatttgttttacatataccagattcacttgatttagctgtggctagtccacttctttgtgcaggtattactacttacagtccattaaaacgttataatattggtaaaggatctcgtgttgcaat

SEQ ID NO: 25516 - DNA, 447 bp, Neocallimastix californiae
  GroES-like
tgaaagaagagctttaagagatgatgatgttgaaattgatattaaatattgtggtatttgtcactcagatattatgattgtacaaattaatcaaccaggaaaaggtgttgttccaggtcatgaaattaccggtgttgtaaaatctgttggtaaggcagttacaaatttcaaagtaggtgatcatgttggtgtaggttgttttgttaactcctgtagtaactgtgaatactgtaaacgtggtgatgaacaattttgtgataagggtgtagttgttgtatttaatagtaaggattatgatggtgcaataacctatggtggttatactcaaactattatcgtcaaagataaatttgttttacatataccagattcacttgatttagctgtggctagtccacttctttgtgcaggtattactacttacagtccattaaaacgttataatat

SEQ ID NO: 25517 - DNA, 405 bp, Neocallimastix californiae
  GroES-like
tgaatgcattggtcttccggcctacactgatgatgaagtggtcattaaggttaagggtgtatccatgcaattcaaagatattatgactgctatggatgctctcattggtttcgatagctatgaaccgggtatggaatgcattggtcgtgttgttgccattggtaagaatgtcgctagcaacccaagaaatcaattacaaattggtgatccagtcattgcattctctcacaaatatggtcatctcttacgtacgtatggtgttgttgatccactctctcttcaaaaaattccagaaagtatgtataaggttgaatatgctggtatctttattgttttcattactgcttattacagtttacatgttcgtgctggtggtattaaacccggccaaactattttaattca

SEQ ID NO: 25518 - DNA, 426 bp, Neocallimastix californiae
  GroES-like
gaagtatagtgaatgcattggtcttccggcctacactgatgatgaagtggtcattaaggttaagggtgtatccatgcaattcaaagatattatgactgctatggatgctctcattggtttcgatagctatgaaccgggtatggaatgcattggtcgtgttgttgccattggtaagaatgtcgctagcaacccaagaaatcaattacaaattggtgatccagtcattgcattctctcacaaatatggtcatctcttacgtacgtatggtgttgttgatccactctctcttcaaaaaattccagaaagtatgtataaggttgaatatgctggtatctttattgttttcattactgcttattacagtttacatgttcgtgctggtggtattaaacccggccaaactattttaattcacgccgctgctgg

SEQ ID NO: 25519 - DNA, 405 bp, Neocallimastix californiae
  GroES-like
tgaagtctttggtcttccagaatgtggacctgatgaagtaattataaaaattcatagtgttgcccttcaattcaaagatataatgagtgtaatgaataatttaccgggttacaacgtttatgaaccaggcatggaaagtaatggttatgttgttaagattggtgaaaatgcaaagaagcatattcaacttcaaattggtcaaccagtttttgcctttactcataagtatggccatatggtttcaacgtatggtaaagctcactacaaattagttaaaccaatgaacaccaatgatatgaatccagaatcttatagttctgttattgttctcggtactgtcttatatgcccttcgtgatcgtgctggcggtgttaaacgaggtcaaagcattttaattcactctgg

SEQ ID NO: 25520 - DNA, 438 bp, Neocallimastix californiae
  GroES-like
taccggtcaaattggtaaattaaagttccgtgaagtctttggtcttccagaatgtggacctgatgaagtaattataaaaattcatagtgttgcccttcaattcaaagatataatgagtgtaatgaataatttaccgggttacaacgtttatgaaccaggcatggaaagtaatggttatgttgttaagattggtgaaaatgcaaagaagcatattcaacttcaaattggtcaaccagtttttgcctttactcataagtatggccatatggtttcaacgtatggtaaagctcactacaaattagttaaaccaatgaacaccaatgatatgaatccagaatcttatagttctgttattgttctcggtactgtcttatatgcccttcgtgatcgtgctggcggtgttaaacgaggtcaaagcattttaattcactctggagc

SEQ ID NO: 25521 - DNA, 330 bp, Neocallimastix californiae
  GroES-like
tgttattgtgaaggtgaaaacgatttctcttcagaataatgatgtccttcaaaattcgtatccggaacttgcagagattatgaagggttccagtgtgattgaatgtgttggtactattgtgaatgttggtagtaaggtaaagaaattcaagagaggcgatttcgtttttggaatcagtttctatggcgattacgttccatccacttatgttaagattccacaagatttagtctttgccgtagatagaaaggataccctgaaacagcaacaacttatttcttccgtttatgcctacacggtagccctctacctcttgaatgaaattcaagc

SEQ ID NO: 25522 - DNA, 336 bp, Neocallimastix californiae
  GroES-like
atgtgttattgtgaaggtgaaaacgatttctcttcagaataatgatgtccttcaaaattcgtatccggaacttgcagagattatgaagggttccagtgtgattgaatgtgttggtactattgtgaatgttggtagtaaggtaaagaaattcaagagaggcgatttcgtttttggaatcagtttctatggcgattacgttccatccacttatgttaagattccacaagatttagtctttgccgtagatagaaaggataccctgaaacagcaacaacttatttcttccgtttatgcctacacggtagccctctacctcttgaatgaaattcaagccaa

SEQ ID NO: 25523 - DNA, 486 bp, Neocallimastix californiae
  GroES-like
tggagtatcacttgttgaaagaagggctttaagagatgatgatgttgaaattgatattaaatattgtggtatttgtcactcagatattatgatagtacaaaataatcaaccaggaaatggtattgttccaggccatgaaattgctggtgttgtaaaatctgttggtaaagcagttacaaatttcaaagttggtgatcatgttggtataggttgttttgttaactcctgtagtaactgtgaatactgtaaacgtggtgatgaacaattctgtgataaaggtgtagttattgtatttaatagtaaggattatgatggtgcaattacctatggtggttatactcaaactattatagtcagagataaatttgttttacatataccagaatcacttgatttagctatggctagtccacttctttgtgcaggtgttactacttacagtccattaaaacgttataatattggtaaaggatctcgtgttgcaat

SEQ ID NO: 25524 - DNA, 450 bp, Neocallimastix californiae
  GroES-like
tgaaagaagggctttaagagatgatgatgttgaaattgatattaaatattgtggtatttgtcactcagatattatgatagtacaaaataatcaaccaggaaatggtattgttccaggccatgaaattgctggtgttgtaaaatctgttggtaaagcagttacaaatttcaaagttggtgatcatgttggtataggttgttttgttaactcctgtagtaactgtgaatactgtaaacgtggtgatgaacaattctgtgataaaggtgtagttattgtatttaatagtaaggattatgatggtgcaattacctatggtggttatactcaaactattatagtcagagataaatttgttttacatataccagaatcacttgatttagctatggctagtccacttctttgtgcaggtgttactacttacagtccattaaaacgttataatattgg

SEQ ID NO: 25525 - DNA, 333 bp, Neocallimastix californiae
  GroES-like
tgagagtgttgttgtgaaggtcagaatgatttctcttcaaaataatgatgttcttcataactcttacccagaactcgctgatatcatgaagtgttctaatgtggtagaatgtgtcggtaccattgttaatgttggtagtagagttaagaacttcaaaagaggtgattttgtttttggtattagtttctatgctgactacgttccttcctcctacgtcaagattcctcaagacttggtggttgttatcaatgaaaaggatagtcagaaacagcaacgccttatttcctcagtttatgcttatactgttgcactctatttattgaatgatattaa

SEQ ID NO: 25526 - DNA, 342 bp, Neocallimastix californiae
  GroES-like
ggacaatgagagtgttgttgtgaaggtcagaatgatttctcttcaaaataatgatgttcttcataactcttacccagaactcgctgatatcatgaagtgttctaatgtggtagaatgtgtcggtaccattgttaatgttggtagtagagttaagaacttcaaaagaggtgattttgtttttggtattagtttctatgctgactacgttccttcctcctacgtcaagattcctcaagacttggtggttgttatcaatgaaaaggatagtcagaaacagcaacgccttatttcctcagtttatgcttatactgttgcactctatttattgaatgatattaaaga

SEQ ID NO: 25527 - DNA, 378 bp, Anaeromyces robustus
  GroES-like
agatgttttaagattaaaagaaattaaaatttcaaaaattaaggatgatgaagtcttagttaaattcttagcctcaccaattaatccttctgatattaatcaaattgaaggtgtttatccaattaaaccaagatttaaggaatatggtgctgttggtggtaatgaaggtgttgctgaagttattgctgctggttcaaaagttaagaatttaactgttggtgattgggttattccagatacaaaagcttttggtacatggcaaacctatgctactagtccagaaaatgaattacaaaaaattagtaaaaatggtatttctagtattagcgctgccaccatttctgtaaacccaccaactgcttacagaatgttaaagga

SEQ ID NO: 25528 - DNA, 492 bp, Anaeromyces robustus
  GroES-like
taaagcaatggtttgtgaaaagcatggtcaaccaaaagatgttttaagattaaaagaaattaaaatttcaaaaattaaggatgatgaagtcttagttaaattcttagcctcaccaattaatccttctgatattaatcaaattgaaggtgtttatccaattaaaccaagatttaaggaatatggtgctgttggtggtaatgaaggtgttgctgaagttattgctgctggttcaaaagttaagaatttaactgttggtgattgggttattccagatacaaaagcttttggtacatggcaaacctatgctactagtccagaaaatgaattacaaaaaattagtaaaaatggtatttctagtattagcgctgccaccatttctgtaaacccaccaactgcttacagaatgttaaaggattttgttaatttaaaaaaaggtgatgttgttattcaaaatggtgctaatagtgctgttggtcaatctgttatacaaat

SEQ ID NO: 25529 - DNA, 273 bp, Anaeromyces robustus
  GroES-like
agctatggtttgtgaaaagcatggtcaaccaaaagatgttttaagtttaaaagaactaaaaatttccaaaattaaagataatgaagttttagttaaatttttagcttctccaattaatccttctgacataaatcaaattgaaggtgtctatccaataaaaccaagatttaaagaatttggtgctgttggtggaaacgaaggtgttgccgaggttattgctgccggtccaaaagtcaagaatttagttgtcggtgactgggttattcctgacac

SEQ ID NO: 25530 - DNA, 492 bp, Anaeromyces robustus
  GroES-like
taaagctatggtttgtgaaaagcatggtcaaccaaaagatgttttaagtttaaaagaactaaaaatttccaaaattaaagataatgaagttttagttaaatttttagcttctccaattaatccttctgacataaatcaaattgaaggtgtctatccaataaaaccaagatttaaagaatttggtgctgttggtggaaacgaaggtgttgccgaggttattgctgccggtccaaaagtcaagaatttagttgtcggtgactgggttattcctgacactaaagcttttggtacttggcaaacttttgccgctagtccagaaaatgaattccaaaaaattaacaaaaatggtatttcaaagattagcgcagctactatatctgtaaacccaccaactgcttatagaatgttaaaagattttgttaatttaaagaaaggtgatgttgttatacaaaatggtgctaatagtgctgttggacaatctgttattcaaat

SEQ ID NO: 25531 - DNA, 465 bp, Anaeromyces robustus
  GroES-like
gactttagaaaacgttagttgtattttaaacaattacccagatggtatggttactgttgataacatgaaagtagttaaaagtccagttccagaattaggtgaaaatgatgtattacttaagaacctttgttgttctattgacccattcatgcgtggtcgtatgagagaaaatgttaagtcttatgttccttcttttgaaaagggaaaggttatgcaagttttttctgttactcaagttgaaaaaattggttctgctgttactgatattaatgttggtgataaatatatgtgtttcaatggtattgaaaaatacaccgttcttccacaacaagttattaaaggtgacggtaaacaatctcttggtagtttcaccaaaattgatcaaagaaacccaattaaggattccttctatctcggtttattcggtatgccaggtatgactgcttgggctttcttcaacaaggt

SEQ ID NO: 25532 - DNA, 459 bp, Anaeromyces robustus
  GroES-like
tagttgtattttaaacaattacccagatggtatggttactgttgataacatgaaagtagttaaaagtccagttccagaattaggtgaaaatgatgtattacttaagaacctttgttgttctattgacccattcatgcgtggtcgtatgagagaaaatgttaagtcttatgttccttcttttgaaaagggaaaggttatgcaagttttttctgttactcaagttgaaaaaattggttctgctgttactgatattaatgttggtgataaatatatgtgtttcaatggtattgaaaaatacaccgttcttccacaacaagttattaaaggtgacggtaaacaatctcttggtagtttcaccaaaattgatcaaagaaacccaattaaggattccttctatctcggtttattcggtatgccaggtatgactgcttgggctttcttcaacaaggtcggtaagcc

SEQ ID NO: 25533 - DNA, 405 bp, Anaeromyces robustus
  GroES-like
tgaagtctttggtcttcctgaatgtagtccagatgaagtagttattaagattcatagtgttgctcttcaatttaaggatgttatgagtgtcatgaataacttaccaggttataatgtttatgaaccaggtatggaaagtaatggttatgtcgtaaagattggtgaaaatgctaaaaaacatattaacctaaaaatcggacaacctgtctttgcctttactcataaatatggtcatatggtttcaacctatggtaaagctcattataaattagttaagccaatgatgaataatgatatgaatccagaaaattacagttctgttattgttcttggtactgttttatatgctcttcgtgatcgtgcaggaggtgttaaaccaggtcaaagtattttaattcaatctgc

SEQ ID NO: 25534 - DNA, 429 bp, Anaeromyces robustus
  GroES-like
tggtcaaattggtaaattaaaattccgtgaagtctttggtcttcctgaatgtagtccagatgaagtagttattaagattcatagtgttgctcttcaatttaaggatgttatgagtgtcatgaataacttaccaggttataatgtttatgaaccaggtatggaaagtaatggttatgtcgtaaagattggtgaaaatgctaaaaaacatattaacctaaaaatcggacaacctgtctttgcctttactcataaatatggtcatatggtttcaacctatggtaaagctcattataaattagttaagccaatgatgaataatgatatgaatccagaaaattacagttctgttattgttcttggtactgttttatatgctcttcgtgatcgtgcaggaggtgttaaaccaggtcaaagtattttaattcaatc

SEQ ID NO: 25535 - DNA, 468 bp, Piromyces finnis
  GroES-like
gactattgaaaacgttagttgtaccttaaacagatacccagagggtatggttaaacttgatgattttaagattgttcaaggtccaattccagaaattagtgataatgatgttttactcaaggttctttgctgttctgttgatccattcatgcgcggtcgtatgaagaaggataacccaagttcttatgttccaccatgtcaaccaggtaaagttatccaagttttctctattacccaagttgaaaagattggtgctaatgttaccgatattaatgttggtgacaagtacatgtgtttcaacggtattgaaaaatacactgttgttccacaacaagctattaagggagatggccaaaagaacctcggtaactacaacaagattgatccaaacaatccaataaaggattcattctaccttggtttattcggtatgccaggtatgactgcttgggctttctttaacaaggt

SEQ ID NO: 25536 - DNA, 459 bp, Piromyces finnis
  GroES-like
ttgtaccttaaacagatacccagagggtatggttaaacttgatgattttaagattgttcaaggtccaattccagaaattagtgataatgatgttttactcaaggttctttgctgttctgttgatccattcatgcgcggtcgtatgaagaaggataacccaagttcttatgttccaccatgtcaaccaggtaaagttatccaagttttctctattacccaagttgaaaagattggtgctaatgttaccgatattaatgttggtgacaagtacatgtgtttcaacggtattgaaaaatacactgttgttccacaacaagctattaagggagatggccaaaagaacctcggtaactacaacaagattgatccaaacaatccaataaaggattcattctaccttggtttattcggtatgccaggtatgactgcttgggctttctttaacaaggttggtaagcc

SEQ ID NO: 25537 - DNA, 375 bp, Piromyces finnis
  GroES-like
agatgttttaagattaaaggaacttactattccaaaaattaaagatgatgaagttttagttaaatttttagctgcaccaattaatccttccgatattaatcaaatcgaaggtgtttatccaattaagccaagatttaaaaagtatggtgctgttggtggaaacgaaggtgttgctgaagtcgttgctgctggtaacaaagttaaaaatttaactgttggtgattgggttattccagatactaaagcttttggtacttggcaaacttttgctgctagtccagaaaatgaattacaaaaaatcagtaaaaatatttcaaaaattagtgctagtactatttctgttaatccaccaactgcttacagaatgttaaaaga

SEQ ID NO: 25538 - DNA, 489 bp, Piromyces finnis
  GroES-like
taaagctatggtttgtgaaaagcatggtaaaccaaaagatgttttaagattaaaggaacttactattccaaaaattaaagatgatgaagttttagttaaatttttagctgcaccaattaatccttccgatattaatcaaatcgaaggtgtttatccaattaagccaagatttaaaaagtatggtgctgttggtggaaacgaaggtgttgctgaagtcgttgctgctggtaacaaagttaaaaatttaactgttggtgattgggttattccagatactaaagcttttggtacttggcaaacttttgctgctagtccagaaaatgaattacaaaaaatcagtaaaaatatttcaaaaattagtgctagtactatttctgttaatccaccaactgcttacagaatgttaaaagacttcgttaacttaaagaaaggtgatgttattattcaaaatggtgctaatagtgctgttggtcaagctgttattcaaat

SEQ ID NO: 25539 - DNA, 405 bp, Piromyces finnis
  GroES-like
tgaagttttcggtttaccagaatgtggtccagacgaaattattattaagattcaaagtgttgcccttcaatttaaagatattatgagtgtcatgaataatttaccaggttacaatgtatatgaaccaggtatggaaagtaatggttatgttgttaagattggtgaaaatgctaagaagcacgttaatttcaagattggacaacctgtctttgcctttactcataaatatggacatatggtttctacctatggtaaagctcactataagttggttaagccaatgatcaataatgatatgaatccagaaaactacagttctgttgttgtcatgggtactgtattatatgctattcgtgatcgtgctggtggcattaaaccaggtcaaagtattttaattcagtcagc

SEQ ID NO: 25540 - DNA, 429 bp, Piromyces finnis
  GroES-like
tggtcaaattggtaaattaaagttccgtgaagttttcggtttaccagaatgtggtccagacgaaattattattaagattcaaagtgttgcccttcaatttaaagatattatgagtgtcatgaataatttaccaggttacaatgtatatgaaccaggtatggaaagtaatggttatgttgttaagattggtgaaaatgctaagaagcacgttaatttcaagattggacaacctgtctttgcctttactcataaatatggacatatggtttctacctatggtaaagctcactataagttggttaagccaatgatcaataatgatatgaatccagaaaactacagttctgttgttgtcatgggtactgtattatatgctattcgtgatcgtgctggtggcattaaaccaggtcaaagtattttaattcagtc

SEQ ID NO: 25541 - DNA, 348 bp, Piromyces finnis
  GroES-like
ttccaaacatgaaatggataaggagagtgttgtggtaaaagttagtacaatttctcttcaaaataatgatattcttcaaaattccttaccagatctttcaagtcttatgaaggattccagtgttgctgaatgtattggtactattgttcatacaggttctaatgttaaaaactttaaaaaaggcgatgttgtctttggtttgaatcttcaggcaaatgatattccatcaacatacgttaagattcatcaagatttggttttcccagtgaatactatggatatggataagcaaaataaccttctttcatctgtttatgcttacaccgtagctatttatcttttaaatga

SEQ ID NO: 25542 - DNA, 357 bp, Piromyces finnis
  GroES-like
tgacctttccaaacatgaaatggataaggagagtgttgtggtaaaagttagtacaatttctcttcaaaataatgatattcttcaaaattccttaccagatctttcaagtcttatgaaggattccagtgttgctgaatgtattggtactattgttcatacaggttctaatgttaaaaactttaaaaaaggcgatgttgtctttggtttgaatcttcaggcaaatgatattccatcaacatacgttaagattcatcaagatttggttttcccagtgaatactatggatatggataagcaaaataaccttctttcatctgtttatgcttacaccgtagctatttatcttttaaatgaaat

SEQ ID NO: 25543 - DNA, 399 bp, Piromyces finnis
  GroES-like
tatcggtcttccaaagtataatgatgaccaaattgttataaagaccaagggtgtttctatgcaattcaaggatatcatgactgccatggataccttggttggttttgatgactatgaaccaggtatggaatgtattggtcgtgttgtagctattggtaagaatgttgccagtgatccaaagaatgtattacaaattggtgatccagtcgttgcttttgcccacaagtatggtcatcttcttcgtacctatggtgtagctgatccactttccgttcaaaagattccagaaagtatgtacaaggttgaatatgctggtatctttattgttttcattactgcttactacagtttacacgttcgtgctggtggtattaaaccaggtcaaaccattttaattca

SEQ ID NO: 25544 - DNA, 435 bp, Piromyces finnis
  GroES-like
cggtcaaatgaagtttaccgaatgtatcggtcttccaaagtataatgatgaccaaattgttataaagaccaagggtgtttctatgcaattcaaggatatcatgactgccatggataccttggttggttttgatgactatgaaccaggtatggaatgtattggtcgtgttgtagctattggtaagaatgttgccagtgatccaaagaatgtattacaaattggtgatccagtcgttgcttttgcccacaagtatggtcatcttcttcgtacctatggtgtagctgatccactttccgttcaaaagattccagaaagtatgtacaaggttgaatatgctggtatctttattgttttcattactgcttactacagtttacacgttcgtgctggtggtattaaaccaggtcaaaccattttaattcatgctgctgctgg

SEQ ID NO: 25545 - DNA, 405 bp, Neocallimastix californiae
  HMG_CoA_synt_C
ttcaaagatatataaggaaagagtagaagcttctactttaatgactgctaatatgggctgtatgtataatgcttctgtcttaaatggtattatttcattaaatgaatccttaactccagatgatattggtaaacgtgcattagtttattccttcggttctggttctgttggtgctctctggactttacgtatcgatggtttagctgaaaaggatgatttagttaatagattaagtaatcgaaaagaagtttctgttgatacttatttcgaaatcagaaaattatggcttgaagaaattaaaaagtttggacgttcttacaaaaaagatcaatttgaacttccaattcgtgatggtgattattatttagcaagtgtttcttctaatggtgttcgtaaatatgaaat

SEQ ID NO: 25546 - DNA, 237 bp, Neocallimastix californiae
  HMG_CoA_synt_C
tcgtggtatatttagtaatagtacttttgatttctataagccttatggatacaagaatcattatccagtagtagatggcaagtattctataaagtgttatcttgattccttaaagagttgctatgaagatcttaagaagaagacaaagtctgaaacagaattccttgatcatcaatttggtgtcttccataattctagtgtttctctaacaagaaaaggtttcaatactttaatgga

SEQ ID NO: 25547 - DNA, 237 bp, Anaeromyces robustus
  HMG_CoA_synt_C
tcgtggtattttcagtaatagtacttttgatttctataagccatatggttataaaaatcattatccagtggttgatggtaaatattctattgattgttatcttaattctttagttagttgttatgaagatcttaaaaagaaatctaaatctgaaacagaattccttgatcatcaatttggtgttttccataattctagtgttagtttaacaagaaaaggtttcaatactttaattga

SEQ ID NO: 25548 - DNA, 402 bp, Anaeromyces robustus
  HMG_CoA_synt_C
gaaaatttataaagaaagagttgaagcttctactttaatgactgctaatatgggttgtatgtataatgcttcagttcttaatggtattatttcattaaatgaatccttaaaaccagaagatattggtaaacgtattttagtttattcatttggttcaggttctgttggtgctctttggtcattacgtattgacggtttagctgaaaaggatgatttaaataatagattaaataatcgtaaagaaatttcagttgattcttactttaaggtaagacaattatggcttgaagatattaagaagtttggtcgttcttataagaaagatcaatttgaacttccaatacgtgatggtgattattatttatcaagtgtatctgtcaatggcgttcgtaaatatgaaat

SEQ ID NO: 25549 - DNA, 234 bp, Piromyces finnis
  HMG_CoA_synt_C
tggtattttcagtaatagtacttttgacttttataagccatatggttacaaaaaccattacccagtagttgatggtaaatactctatagattgttacctttcttccttaaagagttgttatgaacaacttaagaagaagactggttctgaaaccgaattccttgatcatcaatttagtgttttccataattcaagtgttagtttaactagaaagggtttcaatactttaattga

SEQ ID NO: 25550 - DNA, 405 bp, Piromyces finnis
  HMG_CoA_synt_C
ttcaaatgtttacaaagaaagagttgaagcctctactttaatgacagctaatatgggttgtatgtacaatgcttctgttcttaatggtattatttccttaaatgaatctttaaccccagaagatattggcaaacgtgttttggtttactctttcggttcaggatctgttggtgctctttggactttacgtattgatggcttagctgaaaaggatgatttagttaatagattgaatagtcgtaatgaagtttcagtagatacatactttgaaattagaaaattatggcttgaagagattaaaaagtttggacgttcatacaagaaggatcaatttgaacttcaaatccgtgaaggtgattattatttatcaagtgtttcccttgatggtgtacgtaaatatgaaat

SEQ ID NO: 25551 - DNA, 507 bp, Neocallimastix californiae
  HMG_CoA_synt_N
aaatgttggtataattggtttagcatcttatattccaagtactaccgtaaatatgtctaagttagaagttcatgataattgtcaaggtaaatatacaattagtcttggtcaaaagtatatgtctttaactgctccaaatgaagatgtagtttctatggccttaaatgctgtgaagcgtttaatgaaaaagatgaacttaaagccaagtgatattggaagaattcaaattggtacagaaactcctgtagatttaagtaaaagtgtgaagacatttattgttgaacaattctttgatcaaggtattactgatattgaaggtgttgataatgttaatgcttgctttggttctactgcagctttattcgatactgttgcttggatgcaaagtgaattttggaatggtagatatgctattgttgttggaactgatatttcacaaggtgaagatatttatcacttccttacaggttcttccgctgttgctgtcttaattggcccaaatgctaa

SEQ ID NO: 25552 - DNA, 507 bp, Anaeromyces robustus
  HMG_CoA_synt_N
aaatattggtattattggtttagcaacttatattccagcaacaactgttagtatgacaaaattagaagctcatgataaatgtcaaggtaaatatactattagtttaggccaaaagtatatgtcattaactgctccaaatgaagatgttgtatctatggccttaaatgctgttaaacgtttaatgaaaaaaatgaatttaaaaccaagtgatattggtagaattcaaattggtactgaaacaccagtagatttaagtaaaagtgttaaaacatttattgtagagcaattctttgaacaaggtattactgatattgaaggtgttgataatgttaatgcttgttttggttctactgctgctttatttgatactgttgcttggatgcaaagtgatttctggaatggtagatatgctattgttgttggtacagatatttctcaaggtgaagatatttatcacttccttacaggttcatcagctgttgctgttttaattggtccaaatgctaa

SEQ ID NO: 25553 - DNA, 507 bp, Piromyces finnis
  HMG_CoA_synt_N
aaacgttggtatcattggattagctacctacattccaagtagtactgttaatatgaccaaattagaagcgcatgataattgtcaaggtaaatatactattagtttaggacaaaagtacatgtcattaactgcaccaaatgaagatgttgtatccatggctttaaatgctgttaaacgtttaatgaagaagatgaacttaaagccaagtgatattggtagaattcaaattggtactgaaacaccagttgatttaagtaagagtgtcaagacctttattgttgaacaattctttgaacaaggaattactgacattgaaggtgttgataatgttaatgcttgcttcggttctactgctgccttattcgatactgtagcttggatgcaaagtgacttctggaatggtagatatgctattgttgtaggtactgatatttctcaaggtgaggatatttatcacttccttactggttcatcagccgttgcattattaattggtccaaacgctaa

SEQ ID NO: 25554 - DNA, 375 bp, Neocallimastix californiae
  HotDog_dom
tgctaaggaacacttcaactacaatgaaagagatgttatcttatattcaattggtgttggtatcaccaaaaaggaactatcctatgtttatgaaaattcacctgatttcaaggttcttccaaccttctccactgttccagctatggactatttctcaaaaatgaaccttgctaatgttttaccaatattttcaccagaagctttaatacaaacaaagcattatatggaattaaataaaacattcgaaccaaaagataatgttgtttcaaaaggtaaaattgttgatatcataaagactaagatgggtgctgttttaattactgctatctctacatatgataaagatggtaatgaaatttgttataatgaattcca

SEQ ID NO: 25555 - DNA, 444 bp, Neocallimastix californiae
  HotDog_dom
acatcttcttcgtcatgttgataaatatgatcactgcccagaaaagtctttaggatctaaagctaatacagttattactattccaaagagaaaacctgatgctattgttaaagaacgtacttctgaagatcaagctattctttatcgtttatctggtgataagaatccattacatgttgatccagctatggcttctattgccggttaccattcaccagttttacaaagtctttgtgttttagctatcagtactcttcatatcattcaaaccttctgttatggtgatgtcgccagtattaaatctattcaagctgattttgtttcacatgtattcccaggtgaaactttacaaactaatatgtggcaagatggtacaaagattttattcaatgttaaggccttagaaagagatgttattgttatctctaatgctgctgtacaact

SEQ ID NO: 25556 - DNA, 378 bp, Neocallimastix californiae
  HotDog_dom
tgctaaggaacgtttcaactacaatgaaaaagatgttatcttatattctcttggtgttggtattactaagaaggaactttcttatgtttatgaaaattcaccagatttcaaggttcttccaacgttctccactgttccagctttagactacttctctaaaatgaatcttagtaatattttaccaatattttcaccagaagctttaatacagaccaagcactacatggaattaaataaaacatttgaaccaaaggataatgttgtttcaaagggtagaattattgatattataaaaagcaagatgggagctatcttagttactgctatctctacttatgatgaagaaggtaatgaaatttgttacaatgaattccaaca

SEQ ID NO: 25557 - DNA, 441 bp, Neocallimastix californiae
  HotDog_dom
tcttcttcgtcatgttgataactatgatcactgcccagaaaaggccatagaatctaaggctaatactgtcattactattccaaagagaaaaccagatgctattgttaaggaacgtacttctgaagatcaagcaattctttaccgtttatctggtgaaaaaaatccattacatgttgatccagctatggcttctattgctggttatcattccccagttttacaaagtctttgtgttttagctatcggtacactacatattattcaaaccttctgttatggtgatgttgccagtgttaaatcaattcaggcagatttcgtttcacatgtattcccaggtgaaactttacaaactaatatgtggcaagatggtactaaaattttatttaatgttaaagctttagaaagagatgtcattgttatctctaatgctgcagtacaact

SEQ ID NO: 25558 - DNA, 342 bp, Neocallimastix californiae
  HotDog_dom
aaacactaatgaagattactctcttgcctctggtgatgtaaatccaattcacactaactactactttgctaacttggctgatcttgatgttccaattactcacggtatgtggactagtgctgctactcgtcgttatgttgaaacctatgccgctgataatgatgctgaacgtgtcgtttcctacaaggttaactttataggtatggtttctccaaaggatgaacttcgtaccagccttactcatgttggtatgcacaatggtagaaagatcattaaggtttccgtcaaggacttacgtactaacgaaaccgttatggaaggtgaagctgaagttaagcaaaa

SEQ ID NO: 25559 - DNA, 306 bp, Neocallimastix californiae
  HotDog_dom
tcatccatccaacaaggttgttccatccatggactttatcattgttacctcctgggtttctgtcttcaagactatctttgccaaggaatttgatgctgatatcacacgtttagtccacatgaacaacggttatgaagtcattgatccacgtccattacgtattggtgaagttgttgatactcgttccatcatttctgctgttactaaccttgactctggtaagttaattgaggttactggtcatgtcttcagagaaggtaaggaatacgttaaggttacctctagcttcttatgtcgtggtaagtt

SEQ ID NO: 25560 - DNA, 327 bp, Neocallimastix californiae
  HotDog_dom
tcgtgctgaatcttacactgaccgtggtcaaaaggtcttatttgctccaatggatttcgctattgttgttggttggcagagtattatccgtgctatcttcccaaaattcatcaatgccgatttattaaagttggttcatttaactaacggattccgtatgattgataatgaatctggtttaaaggaaggtgatattgttaagactgaatctcgtattattagtgttattaatgatgaaactggtaagattgttgaagttaagggtgtcttaaagcgtgatgaaaagccatttatggaagttatttctaagttcttctaccgtggtgt

SEQ ID NO: 25561 - DNA, 345 bp, Neocallimastix californiae
  HotDog_dom
tcactcctctaacattggatactcccgtgtctccggtgatgttaatccaattcatactaacccatactttgctcaattagctgatcttccaggtaacattactcacggtatgtggactagtgcctctactcgtaagtttgttgaaacctttgctgctgaaaaccatccacatcgtgttacctcttatgaagttaaattcttagatatggtcttcccaggtgatcgtttagaaaccaagcttttccatactggtatggctaatggtaagaaaattattcaatgtaagacgatcaaccaagatggtaaggtggttcttgaaggtactgctgaagttgaacaacctat

SEQ ID NO: 25562 - DNA, 345 bp, Neocallimastix californiae; identical to SEQ ID NO: 25561
  HotDog_dom

SEQ ID NO: 25563 - DNA, 327 bp, Neocallimastix californiae; identical to SEQ ID NO: 25560
  HotDog_dom

SEQ ID NO: 25564 - DNA, 345 bp, Neocallimastix californiae
  HotDog_dom
tcactcttccaacttaggatactctcgtgtttccggtgatgttaacccaatacacactaatccatactttgctcaattagctgatcttccaggtaacattactcacggtatgtggactagtgcttccactcgtaagtttgttgaaacctttgctgctgaaaaccatcctcaccgtgtaacttcctatgaagttaaattcttagatatggtattcccaggtgatcgtttagaaactaagctcttccatactggtatggctaacggtaaaaaaattattcaatgtaagacgatcaaccaagacggtaaggttattcttgaaggtactgctgaggtggaacaaccaat

SEQ ID NO: 25565 - DNA, 327 bp, Neocallimastix californiae
  HotDog_dom
tcgtgctgaatcctacactgaccgtggtcagaaggttttatttgcaccaatggatttcgctatcgttgttggttggcaaagtattatccgtgctatcttcccaaaattcatcaatgccgatttattaaaattggttcacttatctaacggtttccgtatgattgataatgaattaggattaaaggaaggtgatgtcgttaagactgaatctcgtattattagtgttgtcaatgatgaaactggtaagattgttgaagttaagggtgtcttaaagcgtgatgaaaagccattcatggaagttatttctaagttcttctatcgtggtat

SEQ ID NO: 25566 - DNA, 342 bp, Neocallimastix californiae
  HotDog_dom
aaacactaacgaagattactctcttgcctctggtgatgttaatccaattcacaccaactactactttgctaacttggctgatcttgatgttccaattactcacggtatgtggactagtgccgctactcgtcgttacattgaaacctatgccgctgataatgatgctgaacgtgtcgtttcctacaaggttaactttattggtatggtttctccaaaggatgaacttcgtaccagccttactcatgttggtatgcacaatggtagaaagatcattaaggtttccgttaaggacttacgtactaacgaaaccgttatggaaggtgaagccgaagttaagcaaaa

SEQ ID NO: 25567 - DNA, 306 bp, Neocallimastix californiae
  HotDog_dom
tcatccatctaacaaggtcgttccatccatggactttatcatcgttacctcctgggtttctgtcttcaagactatctttgctaaggaattcgatgctgatattactcgtttagttcacatgaacaatggttatgaagttattgacccacgcccattaaagatcggagaactcgtcgatactcgttccatcatttctgctgttactaaccttgactctggtaagttaattgaagttaccggtcatgtcttcagagaaggtaaggaattcgttaaggttacctctagcttcttatgtcgtggtaagtt

SEQ ID NO: 25568 - DNA, 381 bp, Anaeromyces robustus
  HotDog_dom
cccaaaagaacgtttccaatatagtgaaagagatgttattttatattctcttggtgttggtattactaagaaagaactttcttatgtttatgaaaattcaccagatttcaaggttcttccaaccttttcaacggttccagctatggattatttctcaaaaatgaatcttgctaatgtattacctgttttctcaccagaatctttaatacaaactaaacattatatggaattaaataaaattttcgaaccaaaagattgtgttgtttctactggtaaaattgttgatattataaaaactaaaatgggtgctgtattaattactgctattaccacttacgatcaagatggtaatgaaatttgttataatgaattccaacatct

SEQ ID NO: 25569 - DNA, 438 bp, Anaeromyces robustus
  HotDog_dom
tcttcgtcatgttgataattatgatcattgtccagataaagctccagaatcaaaagctaatactttaattactatcccaaaaagaaaaccagatgctattgtaaaagaacgtacttctgaagatcaagctattctttatcgtttatctggtgataagaatccattacatgttgatccagctatggcttccattgcaggttatcattctccagttttacaaagtttatgtgttttagctattagtactcttcatattattcaaaccttctgttatagtgatgttgctagtattaaatctgttcaagctgattttgtttcacatgtattcccaggtgaaactttacaaactaatatgtggcaagatggtactaaaattttattcactgttaaagctttagaaagagatgttattgttatttccaatgctgctgtacaact

SEQ ID NO: 25570 - DNA, 303 bp, Anaeromyces robustus
  HotDog_dom
tccttctaataagattgttccatccatggactttattattgttacttcctgggtttctgttttcaaaactatttttgctaaggaatttgatgctgatattactcgtttagttcatatgaataatggttatgaagttattgatccacgtccattacaaattggagaaattgtagatactcgttctattatttctgctgttactaatttagattctggtaaattaattgaagttactggtcatgtctttagagaaggtaaggaattcattaaggtcactagtagtttcttatgtcgtggtaaatt

SEQ ID NO: 25571 - DNA, 342 bp, Anaeromyces robustus
  HotDog_dom
aaataccaatgaagattattctcttgcctctggtgatgttaatccaattcacaccaactattactttgctaatttagctgatcttgatgttccaattactcatggtatgtggactagtgctgctacccgtcgttatgttgaaacctatgctgccgataatgatgctgaacgtgtcgtttcctacagagttaactttattggtatggtatcaccaaaggatgaacttcgtactagtcttactcatgttggtatgcataatggtcgtaagattattaaggtttccgttaaggatttacgtaccaatgaaaccgttatggaaggtgaagctgaagttaaacaaaa

SEQ ID NO: 25572 - DNA, 324 bp, Anaeromyces robustus
  HotDog_dom
agctgaatcttacactgatcgtggtcaaaaggtcttatttgctccaatggatttcgctattgttgtaggttggcaaagtattattcgtgccatcttccctaaatttattgatgctgatttattaaaattagttcatttatctaacggtttccgtatgattgaaaatgaaactggtttaaaggaaggtgatgttgttaagactgaatctcgtattattagtgttgttaatgatgaaactggtaagattgtagaagttaagggtgtcttaaaacgtgatgaaaaaccattcatggaagttatttctactttcttctatcgtggtat

SEQ ID NO: 25573 - DNA, 345 bp, Anaeromyces robustus
  HotDog_dom
tcactcctctaaccttggttattcacgtgtttctggtgatgtcaatccaattcatactaatccatactttgctcaattagctgatcttccaggtaacattactcatggtatgtggactagtgcttctactcgtaagtttgttgaaactttcgctgctgaaaatcatccacatcgtgttacttcttatgaagttaaattccttgatatggttttaccaggtgatcgtttagaaactaaacttttccatactggtatggctaatggtaagaagattattcaatgtaagaccattaatcaaaacggtcaagtcattttagaaggaactgctgaagttgaacaaccaat

SEQ ID NO: 25574 - DNA, 324 bp, Piromyces finnis
  HotDog_dom
agctgaatcctacaccgaccgtggtcaaaaggttttatacgctccaatggatttcgctattgttgttggttggcaaagtataattcgtgccattttcccaaagtttattaatgctgatttattaaagttagttcatctttctaacggtttccgtatgattgataatgctactggtttaaaggaaggtgatattgttaagactgaatctcgtattattagtgttattaatgatgaaaatggtaagattgttgaagttaagggtgttcttaagcgtgatgaaaagccatttatggaagttatttctaaattcttctaccgtggtgt

SEQ ID NO: 25575 - DNA, 345 bp, Piromyces finnis
  HotDog_dom
tcactcctctaaccttggatactctcgtgtatcaggtgatgttaacccaatccacactaatccatactttgctcaattagctgatcttcctggtaatattactcatggtatgtggactagtgcctctactcgtaagtttgttgaaacatttgctgctgaaaatcatccacaacgtgttacttcttatgaagttaatttcttagatatggttttcccaggtgatcgtttagaaactaaactttaccatactggtatggctaatggtaagaagattattaaatgtaaaactattaatcaaaatggacaagttattcttgaaggtactgctgaagttgaacaaccaat

SEQ ID NO: 25576 - DNA, 324 bp, Piromyces finnis; identical to SEQ ID NO: 25574
  HotDog_dom

SEQ ID NO: 25577 - DNA, 345 bp, Piromyces finnis; identical to SEQ ID NO: 25575
  HotDog_dom

SEQ ID NO: 25578 - DNA, 345 bp, Piromyces finnis; identical to SEQ ID NO: 25575
  HotDog_dom

SEQ ID NO: 25579 - DNA, 324 bp, Piromyces finnis; identical to SEQ ID NO: 25574
  HotDog_dom

SEQ ID NO: 25580 - DNA, 324 bp, Piromyces finnis; identical to SEQ ID NO: 25574
  HotDog_dom

SEQ ID NO: 25581 - DNA, 345 bp, Piromyces finnis; identical to SEQ ID NO: 25575
  HotDog_dom

SEQ ID NO: 25582 - DNA, 444 bp, Piromyces finnis
  HotDog_dom
ccatcttcttcgtcacgttgatcactatgataactgtccagaaaaggccttagaatcaaagatgaataacactgtcgttattccaaagagaaagccagacgctattgttaaggaacgtacttctgaagatcaagccattctttaccgtttatctggtgaaaagaacccattacacgttgatccagctatggcttccattgctggttacaattcaccagttttacaaaacctttgtgttttagccatcagtactcttcatgtcattcaaaccttctgttatagtgatgttgctagtgttaagtctattcaagctgactttgtttctcatgtcttcccaggtgaaactttacaaactaatatgtggcaagaaggtaccaagatcttatttaccgtcaaggctttagaaagagatattgttgttatttctaatgctgctatccaact

SEQ ID NO: 25583 - DNA, 372 bp, Piromyces finnis
  HotDog_dom
caaggaaaagttttcttacagtgaaagagatgttatcttatattcccttggtgttggtattaccaaaaaggaactctcttacgtttatgaaaattctccagacttcaaggttcttccaaccttctccaccgttccagccttagactacttctccaagatgaacctctctaacatattaccaatctttactccagaaaccttcatacaaaccaaacactttatggaattaaaaaagattttcgaaccaaaagatgttgttgtttcaaagggtaaaattgttgacataataaaaacaaaactaggtgctgttttagttactgctatatccacttatgatcaagatgataatgtcatttgttataatgaattcca

SEQ ID NO: 25584 - DNA, 291 bp, Anaeromyces robustus
  HxxPF_rpt
tcaagatatttcattttcagaattattgaaattattgaagttaaagaaaataaacaactcatttgtttttcaaccaaaagtaatgtttaataataataattcagagaattcaatattttcggatgataataatgaaaatatgtttacattgtatgaaagttctaatgaattgcttaataaagagaattcaaaatttgatattacttttaatgttgttgaaaacgaagaaaactatttaatttcaatcatctataatgaccatctttatgaatcaaaaattattaataatat

SEQ ID NO: 25585 - DNA, 303 bp, Anaeromyces robustus
  ICP-like
tgaagaccaatatgataatacaatttatgttgaaagtaatcatatccttaaaattactgtaggtgataatagttctactggatatcaatggattattcttaatgaagatgatattcgtcgttctgattatattgattttataggttctaattatgaaagtcactgtcaaccaaataaatatggagaattccctactggttgtggtggtagccttaccttccattatcgtatatgggaagttactgaagaagatgtattaccaaatattaagatggcttatgttagaccatgggaagttataaa

SEQ ID NO: 25586 - DNA, 306 bp, Anaeromyces robustus
  Inhibitor_I42
ttatgttgaaagtaatcatatccttaaaattactgtaggtgataatagttctactggatatcaatggattattcttaatgaagatgatattcgtcgttctgattatattgattttataggttctaattatgaaagtcactgtcaaccaaataaatatggagaattccctactggttgtggtggtagccttaccttccattatcgtatatgggaagttactgaagaagatgtattaccaaatattaagatggcttatgttagaccatgggaagttataaatcctctccctagtcttgattttcaatt

SEQ ID NO: 25587 - DNA, 624 bp, Neocallimastix californiae
  Inosine monophosphate dehydrogenase (IMPDH)
tgaactcttaatggatactcgttacactcgtttaactggtcgtccacctcttcttgttggtggtatgactccaactaccgctaacccacaatttgtttctgccgttattaacgccggttacaatgttgaagttggttgtggtgctctttacgcccctcacgttttagataaatgtattaaggatattgttgaaagaattccagatggtgaaggtatcctctgtaacattgttttccttaaccaacgtctttgggccttccaattcccaggtgtcttagatatgcgtaagaaccgtggtattcgtattgaaggtattaccattgctgctggtgtcccatctcttgaatactgtaataagatgatcccacaacttattgatgccggtattccatacattggtttcaaaccaggtaatcgtgatgctatccttaaggttatccaaatcgctcgtaccttcccacaaatgccaattgttgttgaatggactggtggacgtagtggtggtcatcactcttgtgaagatttctatgccccaattcttgaaacctacgctgctttacgtaagcaatccaacattgttgtcgttgttggttccggttttggtgatgatgtcggtactcttcc

SEQ ID NO: 25588 - DNA, 798 bp, Neocallimastix californiae
  Inosine monophosphate dehydrogenase (IMPDH)
attattcgcaccaaaattagttaaatctgctaataatggtaagatttacgttgaaactcgtttcagtcgtttacttggtaaaccaccacttatggttggtggtatgactccaactactgctaatgaaaaccttgttagtgcttgtattaatgctggttatcatattgaattggctggtggtggtcaacactctactcaaatgattcgtgatcgtattaagaagattatgtcaaaggttccttctggtgaaggtattactatgaatattatgttcttaaatgccttccaatggggtttccaatatccattagttcaagaaatgagaaaggaaggtgttccacttgatggtttatgtattgctgctggtgttccaagtcttgatgttgctaatgaaattcttggtaatttaaaggcctgtggaattaaacatgttgctttcaaaccaggtagtgtatctgctattcaacaagttattgctattgctaagcaaaatccagatatgccaattattatgcaatggactggtggtcgtgctggtggtcaccactctttcgaagatttccatcaaccaattattgatacttatgcttctattcgtcgtcaaccaaatattattattgttgttggtagtggttttggtgatgctgaaggtacccttccatacttaactggtgaatgggctcgtaagtttggttatccaccaatgccatttgatggtattttattcggtagtagaattttagttgctgctgaagctggtaccagtgaagaagttaagaagttattagttaaatctga

SEQ ID NO: 25589 - DNA, 795 bp, Neocallimastix californiae
  Inosine monophosphate dehydrogenase (IMPDH)
attattcgcaccaaagttggtaaaatctgctaataatggaaaaatttacgttgaaacccgtttcagtcgtttactcggaaagccaccacttatggtaggtggaatgacgccaactactgcaaatgaaaatcttgttagtgcatgtatcaatgcaggttatcatattgaattagctggtggtggtcaacactccactcaaatgattcgtgaccgtattaagaagattatgtcaaaagttccttctggtgaaggtattaccatgaatattatgttcttaaatgccttccaatggggtttccaatatccattagttcaagaaatgagaaaggaaggtattccacttgatggcttatgtattgctgctggtgttccaagtcttgatgttgctaatgaaattctcggtaatttaaaggcctgtggtataaaacatgttgccttcaagccaggtagtgtatctgctattcaacaagttattgctattgctaagcaaaacccagatatgccaattattatgcaatggactggtggtcgtgctggtggtcaccactcttttgaagatttccatcaaccaatcattgatacttatgcttctattcgtcgtcaaccaaacattattatcgttgttggtagtggtttcggtgatgctgaaggtacccttccatacttaactggtgaatgggctagtaaattcggttatccaccaatgccatttgatggtattttattcggtagtagaatcttagttgctgctgaagctggtactagtgaggaagttaagaagttattagttgaatc

SEQ ID NO: 25590 - DNA, 762 bp, Neocallimastix californiae
  Inosine monophosphate dehydrogenase (IMPDH)
tgaactcttaatggatactcgttacactcgtttaactggtcgtccacctcttcttgttggtggtatgactccaactactgctaactcccaatttgtttctgctgttattaatgccggttacaatgttgaagttggttgtggtgctctttacgctcctcacgtcttagataagtgtattaaggaaattgttgaaaagattccagatggtgaaggtattctctgtaatattgttttccttaaccaacgtctttgggccttccaattcccaggtgtcttagatatgcgtaagaaccgtggtattcgtattgaaggtattaccattgctgctggtgtcccatctcttgaatactgtaaaaagatgatcccacaacttattgatgctggaattccatacattggtttcaagccaggtaaccgtgatgctatccttaaggttattcaaatcgctcgtaccttcccacaaatgccaattgttgttgaatggactggtggacgtagtggtggtcaccactcttgtgaggatttctatgctccaattcttgaaacttacgctgccttacgtaagcaatctaacattgttgtcgttgttggttccggttttggtgatgatgttgaaactcttccattcatcactggtgactggagtattgaattaggttacccaccaatgccatttgatggtttattagttggttctcgtgtctgtgttgctaaggaagctcttaccagtgatggtattaaggaagttattgtaaacacccc

SEQ ID NO: 25591 - DNA, 795 bp, Anaeromyces robustus
  Inosine monophosphate dehydrogenase (IMPDH)
attattcgctccaaaattagttaaatctgctaataatggtaagatttatgttgaaactcgtttcagtcgtttacttggtaaacctccacttatggttggtggtatgactccaactactgctaatgaaaatcttgttagtgcttgtattaatgctggatatcatattgaattagctggtggtggtcaacactctactcaaatgattcgtaaccgtattaagaagattatgtctaatgttccatgtggtgaaggtattactatgaatattatgttcttaaatgctttccaatggggtttccaatatccattagttcaagaaatgagaaaggaaggtatcccacttgaaggtttatgtattgctgctggtgttccaagtcttgacgttgctaatgaaattctttccaacttaaaggcttgtggtattaaacatgttgctttcaaaccaggtagtgttagtgctattaaacaagttattgctattgccagacaaaatccagatatgccaattattatgcaatggactggtggtcgtgctggtggtcaccactcctttgaagatttccatcaaccaattattgatacttacgctattattcgtcgccaaccaaatattattattgttgttggtagtggtttcggtaatgctgaaggtactcttccatatttaactggtgaatgggctcgtaagtttggttatccaccaatgccatttgatggtattttattcggtagtagaattttagttgctgctgaagctggaactagtgaagaagttaaaaaattattagttgaatc

SEQ ID NO: 25592 - DNA, 756 bp, Piromyces finnis
  Inosine monophosphate dehydrogenase (IMPDH)
taagatttacgttgaaactcgtttcagtcgtttaattggtaaaccaccacttatggttggtggtatgactccaactacagctaatgaaaatcttgtcggtgcttgtataaacgctggataccacattgaattagctggtggtggtcaacactccactcaaatgattcgtgaccgtattaagaaaattatgtctaaggttccatctggtgaaggtatcactatgaatattatgttcttaaatgctttccaatggggattccaatacccacttgttcaagaaatgagaaaggaaggtattccacttgaaggtttatgtattgctgctggtgttccaagtcttgatgttgctaatgaaattctcgctaacttaaaggcttgcggtattaaacatgttgcttttaagccaggaagtgtttctgctatccaacaagttattgctattgctaaacaaaatccagatatgccaataattatgcaatggactggtggtcgtgctggtggtcaccactctttcgaagatttccatcaaccaattattgatacctatgctgctattcgtcgtcaaccaaatatcattattgttgttggtagtggtttcggtgatgcagaaggtactcttccatacttaactggtgactgggctcgtaagttcggatatccaccaatgccatttgatggtattttattcggtagtagaatcttggttgctgctgaagctggtactagtgaagaagttaagaaattattagttgcttc

SEQ ID NO: 25593 - DNA, 756 bp, Piromyces finnis; identical to SEQ ID NO: 25592
  Inosine monophosphate dehydrogenase (IMPDH)

SEQ ID NO: 25594 - DNA, 756 bp, Piromyces finnis; identical to SEQ ID NO: 25592
  Inosine monophosphate dehydrogenase (IMPDH)

SEQ ID NO: 25595 - DNA, 756 bp, Piromyces finnis; identical to SEQ ID NO: 25592
  Inosine monophosphate dehydrogenase (IMPDH)

SEQ ID NO: 25596 - DNA, 192 bp, Neocallimastix californiae
  Integrin alpha N-terminal domain
aagaaataagagggctatcactgcttatgctttaaaattccaaaacagaaaattcactgttcaatggactttccgtattcttgattacaagaataaaattccagctggtcacggtatggtagaattccactctattcgtggtgttgatttagatggtgatggttttgatgaaattcatcttggtggtttcgc

SEQ ID NO: 25597 - DNA, 354 bp, Neocallimastix californiae
  Integrin alpha N-terminal domain
ggatagtaaaggggcttcttatcgtgttgaacatgtttatgctggtgatttagatggtgatggtacatatgatttcgttgtgaagcgtatgtcagataatcgtgaccctattcttcttgaagcatacaaattagatggtacattcttatggcgtatgaatcttggtccaaatatcgaaacttacacttcttcccttactagtcctgtcttagtttacgattttgatggtgatggtaaggctgaagttatggttaaaaccagtgaaggtaccgttttcggtgatggtactaagattggtgatgtcaatcatgatggtagaacagattattgtgaaagaaacagaactcaatatca

SEQ ID NO: 25598 - DNA, 183 bp, Neocallimastix californiae
  Integrin alpha N-terminal domain
cttaaaattccaaaacaaaaaattcaccgttcaatggactttccgtattcttgattacaagaacaaaattcctgccggccacggtatggtcgaattccattccattcgtgcccttgatttagatggtgatggctttgatgaaattcatcttggtggttttgctatcgaccacaacggtaaatt

SEQ ID NO: 25599 - DNA, 351 bp, Neocallimastix californiae
  Integrin alpha N-terminal domain
tgcttcctatcgtgttgaacatgtttatgcaggtgatttagatggtgatggtacctatgatttcgttgtgaagcgtatgtcagataatcgtgatcctattcttcttgaagcttataaattagatggtaccttcttatggcgtattaatctcggtccaaatattgaaacttacacttcctctctcactagtcctgtcttggtttacgattttgatggggatggtaaggctgaagttatggttaaaactggggagggtacagttttcggtgacggtactaaaattggtgatgtcaatcgcgatggtaaaacggattatcgtgaaaggaacagaactcagtaccaagttcttac

SEQ ID NO: 25600 - DNA, 72 bp, Anaeromyces robustus
  KAZAL_1
tggtagttatgttgaaccttattgtaatcaagaagccattttatatggttatccatgttgttctgaatgttc

SEQ ID NO: 25601 - DNA, 780 bp, Neocallimastix californiae
  ketoacyl-synt
agttgctgttgttggtattgctttaagacttccaggtggtatcaataccgttgataagtattggaagagtttagaaaatggtagattttgtgtctctccaacaggtactaaccgtcatcttcaccataacatgactcacaatgaggaactaaaaccaggagaacattacattttcaactactgtcgttatgatagtactccagatgcagctcctatcactgattttgatccaatgttctttaatatgaatccaaatgaagccactgttcttgatccaaagttccgttgggtcttagaaactacttatgaagttttacaagatgctggtattaacccagattctctctctggtactcatactaatatttacactgcccctggacaagttgatgaaatgaatgcttatgctactaatgcctctccaactggttacagtgttcttaatggtatgagtatgcatagttgtgcttctgcttccttaccaggtagaattagtttcatgtataatttatttggtgctgctcacaccgtagatactgcctgttcttccggtttagttgctatccatgatgcttttaaggatttgaatattggtgaaactgatcttgccattgtgaatgctgctcactgtccattccaaagttcttctttcagtcttttatcaatagcaaaaatggtttccagaaactgtagatgtgcttcttacgatgaagcagcagatggttacgttccaggggaaggttgtgtttccgttattttaaagagaaaggatgatgccat

SEQ ID NO: 25602 - DNA, 786 bp, Neocallimastix californiae
  ketoacyl-synt
tccaattgctgttgttggtatgggtcttcgtttaccaggtggtattaatactccttctaaatattggaatgctttagttaatggtaaggattgtatttcaccaactcctgctaaccgtcatcttcaccaatatttaaggccattttgcccaccaaatgaattaggcccatttgatcactatattcatcgtgctggttattatgatgttactccagatgctgccccaatttctgattttgatccaactttctttaatatttctccattagaagctaaattcactgaaccaaaattccgttggatctatgaaactgtttatgaagctttccaagatgcttgtataaatgtttctgaattaaatggaactcgtacttctgtttttactactgttggttctactgctgattatattgctttaactaaggcttttactaaagttgaatcaatgactagtcaaactatgcatggttctgctgcttctagttgtgctggtcgtatttccttcaactatggttttattggtccatctgatactattgatactgcttgttctagtggtttaaatgattgtcacaatgcttgtaaatcactttctatgggtgattctgatgtagctgttgtttctgctgttcaccaacaatttgtatctactcaattccatgttatttctgttgctcatatggcttcacaaattggtcgttgtgctacttttgatgctgaagctgatggttatgctcctggtgaaggttgtattagtattattcttaaacgtttagatgatgctgt

SEQ ID NO: 25603 - DNA, 738 bp, Neocallimastix californiae
  ketoacyl-synt
tattattggtattggttgtcatttcccagaaggtatagagtcaaaggaagctttctggaaaatgttagaagatgctcgttgtatcacaaaggatatacccaaggatcgatgggataaaaatgaatggtattctaaggaacctattcaaggtacaattcaaactaaacgtggagccttcctaaaaaacccatatcttttcgataataagtatttctatatctctatgccggaagctaaagaaatgtcaccggaacaacgttggcttttagagttaactgtagaaaccttagaagatgcaaacattaaacctgaagctgtccgaggatcacgtacgggtgtcttcattggatcttctggttgtgattatttagccactcaaatttctcatgccaatgatattaattctcattctcctactggatttgaactttctattttagctaaccgtttatcctatgtttttgatttacaaggaccctccattagttgtaataccgcttgttcttctgcattttctgctttaaatatcggtttaaatgctatgattacggatgattgtgaaatggctctcgttgctggttctaattttatgaattgtccaggtggatttgtggccttctctcaacttcgtgtcgtttctcctgacggttcctgtaaaccttttgatgaaaaggctaacggttatgccagattagaaggagctggtatggtattaattaaaccctatgaaaaggccgt

SEQ ID NO: 25604 - DNA, 774 bp, Neocallimastix californiae
  ketoacyl-synt
aaagattgcaatcattggtatggcttttcgtttacctggagctattagtaattctaaatcattatggatggctttagctaaaagtagggattgcatcttacctccagtgaaaactagagatttacatcatggctatgtgaataagccagccaatcaattaggccccaaggaacactaccttgctcgtgtgggttgttacgatgttcgtcctaacgtggctaaaccttcagaattcgatgcagacttctttaactgttcaccggaagaagctactgctcttgatccaagacatcgttggatcttagaaacgagttgggaagctttagaaaatgctggtattgtaccaagctcgcttaaaaataccatcactggagtctttgtcggtatgaacaatgatcatgaacatgaagatctattaaagaaatgtggtaaagttccaccgttagccgctcatgccaccgctcaaagtagtattgccggtcgtctcagctatttctatgaactctttggtccttcctacaccatcgataccgcctgttctacaggttcctctgcccttcattctgcttgtcagtctatgcaatgtggggactgtgatctttctatcgtttctggcgtaaagtatatgtattccagtgatgaattccataagacttgtgcggctcgtatgacttcgccgaatagtcgttgtgctacctttgacgccagtgccgatggtttcgctcaaagtgaaggttgtgtgacctttgttttaaaacgtcttgaggatgccat

SEQ ID NO: 25605 - DNA, 738 bp, Neocallimastix californiae
  ketoacyl-synt
tgttattggtgttggttgtcgtttcccaggtaatattaaatctaaggaagatttctgggaaatgcttacttcaggtcgttgtcttacttcagaaataccaaatgatcgatggaatactgcggaatggtataacaaggaaccaaagagaggtactatgcaaaccacaagaggtgcttttatggaagatgcattctattttgataataaatacttctctatttctcaaaatgaagctaaagaaatgtctcctgaacaacgttggttaatggaattagcagttgaaacctttgaagatgctaacatcaatccaaagaaattaaagggttcaagaactggtgtatttgtcggctcttctggtatggactttgtttcagcccaaatttctcatgctaatgatttaactcaacattccgctactggtctagaactctcaattcttgctaatcgtatttcttacttctttgatttgaatggtccatccatttgtactaatactgcttgctcagcttcaatgaccgccttaaatcttgctattaattcaatgattactgatgattgcgatgctgcactcgttgctggaactaatttattatttactccaggtagttatgttgcttattctcaacttcgtgttgtttccactgatggttcatgtaagccattcgataagaatgctgatggttattcacgtattgaaggtgctggtatgattttaattaagccatatgaaaaagctgt

SEQ ID NO: 25606 - DNA, 621 bp, Neocallimastix californiae
  ketoacyl-synt
ttctggtcaattaccaaccggttgggatccagctcgttacggtattccaaaagatatcattgaacaagttgatatcattacctgctactgtattgtctctgctgttgaagccttagttagtgctggtattactgatccatacgaattctacgaatacgtccacgtttctgaagttggaaatgcctgtggttctggtgttggtgctgaacttgccaaccgtgctatcttcaaggaccgtttccttgacaagccacttcaaagtgatattcttcaagaaaccttcgttaataccatgagtgcctggattaacttattattactttcttcctctggtccaattcgtaccccagttggtgcctgtgcctctgccgttgaatctgttgatatcggtattgatactattttatctggtaaggctaaggttgtctttgtcggtggttatgatgacttccaagaagaaggttcctatgaattcgctcaaatgaaggctacctctaactctcgtgaagaaatggctcaaggtcgtgaaccaaatgaaatgtctagaccaactgcctcctctcgtggtggtttcatggaagctcaaggtgttggtacacaagttttaatgccagctagcct

SEQ ID NO: 25607 - DNA, 774 bp, Neocallimastix californiae
  ketoacyl-synt
taaaatcgccattattggtatggcattacgtttaccaggtactatcaataattctaaatcattatggatgtcattagccaaaggaagagattgtgttttgccaccagttaaaactagagatttacatcatggttatgtcaacaaatcatttaatgagttaggtccagatgaacactatcttcctcgaattggatgttatgatactcgtagtaatgctgctaaaccttcagaattcgatgcctcgttctttaactgtactgctgaagaagctatctcattagatcctagacatcgttggatcttagaaacaagttgggaggcattagaaaatgcaggtattgctccaaattctttagaaaatactttaaccggtgtctatgtcggtattaataatgaacatgaacatgaagatctattaaaggaatgtggtatcgttccacctgttgcttcccataccttaaatcaaagtagtattgcgggacgtttaagctatttctataaactttttggtccatctttcactatcgatacggcctgctctactggttcttctgcacttcatactgcttgtagagctatgcaatatggtgaatgtgatctatctattgttactggtgtaaaatacatgtattcctccaaggaattccataaaacatgttctgcccatatgacttctccaaacggtcgttgtgctacgtttgatgaaagtgcagatggatttgctcagagtgaaggttgtgttacttttattttaaaacgtcttgatgatgctat

SEQ ID NO: 25608 - DNA, 738 bp, Neocallimastix californiae
  ketoacyl-synt
aatagctattattggtgttggttgtcgtttaccaggtgatattttaaccaaagatgatttttggaatatgttagtaacaaaacgtgttgtcacaactgaaattccagctgatcgttgggatcgtgatgaatggtatagtgatgagcctattccaggtactattcagacgaaacatggtggtttccttactaatgcttatgattttgataataaatatttttctatttctcaagctgaagctcttgaaattactccagaacaacgttggttatgtgaacttgctgttgaaactatggaagatgctaatattcgcccagaagaattaaaaggtagtcaaacaggtgtttttgttggttctgctggtattgattttggtggtaaccaattagttaatacattacaaatgtccgctcataccatgacaggtttagaaccatctatcttttctaatcgtatttcttacattttcgatttacatggtccttccattacaagtaatactgcatgctctgcttcaatgtcctctttatctatggcttgcaatgctattgctgttggtgattgtgataaggcttttgttgctggttccaatttcttaccatctccaggtggctatgttgctttctctcaacttagagtagtttctaagactggttcttgtaaaccatttgatgaaaaagcggatggttatgctagacttgaaggtgcttgtatgcttttaattaaagattatgaaaa

SEQ ID NO: 25609 - DNA, 669 bp, Neocallimastix californiae
  ketoacyl-synt
gaagggatctaccatttacattccaaaggctcttcaatttgatagaactgttgctggtcaaattccaactggttggaagccagaaacctatggtattccaaagagtattattgatcaagttgatccaattaccctttatgttattgttgctactgttgaagctttagttagctctggtattactgatccatacgaattttacgaatatgttcatgtttctgaagttggaaactgttctggtggtggtgttggtggtatggtatccaaccgtaagcaatactttgaacgtctctttgaaaagccagttcaaaatgatattcttcaagaatgcttcatcaacactatgccagcttggattaatttattattactttcttcttctggtccaattaagacaccagttggtgcttgtgctactgccgttgaatctgttgaaattggtttagaaactatcttaagtggaaaggctaagattgttattgttggtggttacgatgacttccaagaagaaggttcctatgaatttgctaacatgaaggctaccagtaactccttagaagaattagctcatggacgtgatccatctgaaatgtctcgtccagctactactactagaggtggtttcatggaatctcaaggtgccggtcatgaaattttgatgacagcttc

SEQ ID NO: 25610 - DNA, 771 bp, Neocallimastix californiae
  ketoacyl-synt
aagagtggcagtgattggtatggctcttcgtttacctggtgccatcaataattctaaatcgttctggatgtctttagccaaaggtagagattgtgtcttggctccagtcaaggatagaaaattacaccttggttatgtggataaaccatctaatcttttaggagaaaatgaacataatattccaaaatgtggttgctacgattctcgttcaaatgcagctaaaccttctgaatttgatgcagaattcttcaactgtttacctgaagaagtcaatagtatggatccaagacaacgttgggtcttagaaacgagttgggaagctttcgaaaatgcaggtattgctccaaataccttagaaaataccaccactggtgttttcgtgggtgtaaatgatgatcatgactatcaagatttattgaaagaaaacggtatcgctcaacctatttcagcacattctactccaagtggtattgctggccgtctcagttacttctataaacttttcggaccttcctttactatcgatactgcttgttctacaggtgcttctgccctccactctgcttgtcgttccttacaatttggagattgtgacttatcagtggtttccggagttaaatatttatattctgcctctgaattccatagaaccagtgttgctcgtatgacctctcctcatggtcgttgtgccacgtttgataaggatgctgatggttttgcaccaggtgaaggttgtgttacgtttattttgaagcgtcttgaagatgctgt

SEQ ID NO: 25611 - DNA, 738 bp, Neocallimastix californiae
  ketoacyl-synt
tatcattggtacgggtattcgtttaccaggtgaaattaataataaggatgacttttggaaggtaatgaccgataaaaaggtgatcaccggtctcattccagaagatcgttgggatcgtgaagaatggtatagtaaggtcgaaaagccaggcaccatacaaacccttcatggaggtttcattgaaaatgctttcgatttcgataataaatattttggtatctctcaaaatgaagcgttggacgccactccagaacagagatggctatgtgaattaacggttgaaaccgttgaagatgccaatatggatatggatgattttaaaggaagtcatacgggggtctttgtgggtacctccggtatggattatggtagttatgtcttttctgttcctgaaaaaattactaaatatacgtacagtggtattgaaccttccatccatgctaatcgtgtctcgtatcttttcaatcttcatggtccatcgctttccactaataccgcttgttcctcttccatgaccgccttatccattgcttgtaattcgatggccgctggtgactgtgaaatggctttagttgccggtactaacttcttccaagccccagctaatggagtagcctattcgcaacttcgtgtcgtttcgaagaagggagcctgtcgtccatttgatattggtgctgatggttatgctcgtttagaaggtgccgccatggtcttgttgaagccatatgaaaaggccat

SEQ ID NO: 25612 - DNA, 774 bp, Neocallimastix californiae
  ketoacyl-synt
tgcgatcgccatcattggtatgggtttacgtcttccaggtgctattaataatgaaaagaccctctggtctgctttagttaaaggtagagattgtgtttccaatattccaaaggatcgtaaactccatgaatcctacgtaaataaaccatctaatgaacttaacccaggagaacataatgttaagaaatgtggttactacgactctcgtacctctggtgaaaaagtttctcaatttgatgctgaattctttaactgtcttccagaagaagccattggtcttgatccaaagcatcgttggattttagaaactagttgggaagccttagaaaatgctggtatctctccagattctcttgaagattccaacactggtgtctttgtcggtatcggtgatcagcaagaccatgcccaattcatgaaggaatgccataggaaaaaggttgtcagttaccacaacagtaatccatctgctattgctggtcgtctcagctacttctacaagctctatggtccttcagtgacagtggatactgcttgttccactggtgccaccgcccttcatacggcctgtcgctccatgatctatggtgattgtcgtctcgccatggtcactgcctctaagtatctcttttacccagaagaatttgaaatgaccagtaaggctagaatgacctctcctaatggtcgttgtgctaccttcgataaggacgctgatggttacgcgcccgctgaaggttgtgttaccttcatcttaaagtgcttagaagatgctga

SEQ ID NO: 25613 - DNA, 771 bp, Neocallimastix californiae
  ketoacyl-synt
aattgctattattggtatgggtcttcgtttacctggtgctattaacagtgcaaaatctctttggttagctttagctaagggtaaggattgtgttttacctccaattaaaactagagatttacatcgtaattacgttaataagccaagtgatcaattagatccaactgaacacaatattcctcgtttaggtttatacgatactagaaatagtgttgctaagccatctcaatttgatgctaagttcttcaattgtttaccagatgaagccttagctcttgatccaagacatcgttggattttagaaactagttgggaagccttagaaaatgctggtattccaccaaactctttagaaaattcttctactggtgtatttgttggtattaacgatgatcacgaatattctgatttattaactgaatgtggcgttaagagtccaattgctgctcatggtcaaagtccaagtggtattgctggtcgtttaagttacttctatagattatatggtccatccttcactatggatactgcttgttcaactggtgcttctgctcttcatactgcatgtcgttcattacaatgcggtgattgtgatttatctattgtttctggtgttaaattcatgtattcttccaaggatttctacatgacttgttctgctagaatgacttcaccacatggacgttgtgccacatttgataaggatgctgatggtttcgtaccaggtgaaggttgtgttaccttcatcttgaagcgtttagaagatgctgt

SEQ ID NO: 25614 - DNA, 684 bp, Neocallimastix californiae
  ketoacyl-synt
gaatgttaaatttaagaagggatcaactatctatattccaaaggctcttcaatttgatagaacagttgctggtcaaattccaacaggttggaaaccagaaacctacggtattccaaagagtattattgatcaagtggatccagttaccctttacgttattgttgctacggttgaagccttaattaactctggtattactgatccatatgaattctatgaatatgttcatgtttctgaagttggaaactgttctggtggtggtgttggtggtatgctttcttcccgtaaggaatactttgaacgtgcatttgagaagccaattcaaagtgatattcttcaagaatgtttcatcaatactatgccagcttggattaacttattgttactttcttcatctggtccaattaagactccagtcggtgcctgtgctactgctgttgaatctgttgaaattggtttagaaacgatcttaagtggaaaggctaagattgtaattgttggtggttacgatgacttccaagaagaaggttcctacgaatttgctaacatgaaggctacgagtaacgcattagatgaattagctcatggtcgtgatccatcggaaatgtctcgtccaggtacgactactagaggtggtttcatggaatcccaaggtgctggacatgaaatcttgatgaccgcctc

SEQ ID NO: 25615 - DNA, 780 bp, Neocallimastix californiae
  ketoacyl-synt
agttgctgtggttggtattgctttaagacttccaggtggtatcaacaccgttgataagtattggaaaagtttagaaagtggtagattctgtatctctccaactggtactaatcgtcttcttcatcacaacctgactcacaatgaacacttaaatcctggagaacattatattttcaactactgtcgttacgatagtacttctgacgtttcccctatcactgatttcgatccattgttctttaacatgaatccaagtgaggctaccgttctcgatccaaaattccgttgggtcttagaaactacttatgaagctttccaagatgccggtataaacccggataccctttctggtactcgtactaatgtatataccgctccaggtcaagttgatgaaatgaatacctacactattgatgcctccccaaccggttacagtattcttaacggtatgagtatgcacagttgtgctgctgcttctttaccaggtagaattagtttcatgtataacttgtacggtgctgcccacactgtagataccgcttgttcttccggtttagtagctactcatgatgctttcaaggatttaaacatcggtgaaactgatcttgctatcgttaatgctgctcactgtccatttcaaagtagtggtttcagtcttttgtctgttgctaagatggtttcaagaaattgtagatgtgctgcttacgatgaagccgctgatggatatgttcctggtgaaggttgtgtctccattatcttaaagagaaaagatgatgccat

SEQ ID NO: 25616 - DNA, 810 bp, Neocallimastix californiae
  ketoacyl-synt
tcgtattgctattgttggtataggattacgtcttccaggaggtattaattcaaccaaaaagttctggttttcattaattaaaggtaagaattgcttatcagctacaccaacggatcgcgaacttcatttaggaatggtagatatgagtaagaagccaccggaatatcgactaaataaaaatgaacattatgtttgtagatatggtatttatgattctcattatgcctcatctggagtaaagtacactgattttgatgctaatttctttgactgctctaccgaggaagctattagcatggatgtcaagcagcgttggatgcttgaaacaagttgggaagctttagaagatgccggtatagatccttcctccatcgaaaattctgataccggagtattcataggaatgaacaattgctatcatcaaacaaagcttttgtcctccaagaaagccactaacattagctcttctttcaatccaaccacccttcattgtacagatctttcatcagtagctggacgaatttcctatttctataagatatacggaccagccatttctatggatactgcatgctcaacaggagctaccgcactacatacagcgtatcgttctatgcaatatggtgaatgtgatttagctattgtatccggggctcgatttctttactacaatgacgaatttattaatacttctcatgctaaaatggcatcaccaaatggacgttgtgccacttttgatgaagatgcggatggatttgcacctgcagaaggttgtgtgaccctcatcttaaaaagactagatagagctga

SEQ ID NO: 25617 - DNA, 810 bp, Neocallimastix californiae; identical to SEQ ID NO: 25616
  ketoacyl-synt

SEQ ID NO: 25618 - DNA, 810 bp, Neocallimastix californiae
  ketoacyl-synt
tcgaattgctatagttggtataggattacgtcttccaggtggcatcaattcaaccaaaaaattctggcattcattattacaagggaaaaattgtttatccactacacctgttgatcgtcaacttcacctgggaatgatagatatggctaaacaacaacctggatataaattaaataaaaatgaacactatattcacaaatatggttattatgattcaattcatacggcttctatagcaaagcctacaaagtttgatgctaatttctttgaatgtactaatgaagaagctattggaatggatgttaagcaacgatggatgctggagactagttgggaagctttagaagatgctggtattgatccttcaactcttgaaaattcaaatacaggtgtatttattggaatgaataactccaatcatcatataaaacttttatcttcagagaaagccactaatgtaggacctaacttcagttcagtcacacttcatggtactgatctttcttcagctgcaggtcgtatttcttatttctataagttatatggcccagcaatttccatagatacagcatgttcaacaggagctacagcattgcatactgcctatcgatctatgcaatatggtgattgtgatctagcaatagtttcaggtgctcgattcctttactataacgatgaatttattaatatttctcatgctaagatgacttcacctaaaggacgttgtgcaactttcgatgaaagtgctgatgggtttgcacctgccgagggttgtgtaacattaattttaaaaagacttgatgatgctga

SEQ ID NO: 25619 - DNA, 459 bp, Neocallimastix californiae
  ketoacyl-synt
ggaagctttagaaaatgctggtattgctccaaattctctagaaaatactttaactggtgtctatgtcggtattaataatgaacatgagcatgaagatttattaaaaaaatgtggtatcgttccaccccttggttcccataccttaaatcaaagcagtattgctggtcgtttaagttatttttataaactttttggtccatccttcaccattgataccgcttgttccacaggttcttctgctcttcatattgcttgtaatgctatgaaacgtggagaatgtgatttatctattgttacgggtgtgaaatatatgtactcctccaaagaatttcataaaacctgttctgcccatatgacttctccaaagggtcgttgtgccacttttgacgccagtgctgatggttttgctcaaagtgaaggttgtgttacttttgttttgaaacgtttggatgacgctat

SEQ ID NO: 25620 - DNA, 621 bp, Anaeromyces robustus
  ketoacyl-synt
ttctggtcaattaccaaccggttgggatccagctcgttatggtattccaaaggatattatagaacaagtagatccaattacatgttattgtattgtttctgctgtagaagctttagttagtgcaggtattactgatccttatgaattttatgaatatgttcatgtttctgaagtcggaaatgcttgtggttcaggtgttggtgctgaaattgctaatcgtgctattttcaaggatcgtttcttggataaaccacttcaaagtgatattcttcaagaaacctttgttaatactatgagtgcttggattaatttattattactttcctcttctggtccaattcgtactccagttggtgcttgtgcctctgctgttgaatctgttgatattggtattgataccattttatctggtaaggctaaggttgtctttgttggtggttatgatgatttccaagaagaaggttcctatgaatttgctcaaatgaaggctacttctaattcacgtgaagaaatggctcaaggtcgtgaaccagatgaaatgtctagaccaaccgcttcctctcgtggtggttttatggaatctcaaggtgttggtactcaagttttaatgccagctagttt

SEQ ID NO: 25621 - DNA, 771 bp, Anaeromyces robustus
  ketoacyl-synt
taaaattgctattattggtatggctttacgtttaccaggagctattaataatgctaaatctttctggatggctttagctaaaggtaaagattgtatttctacaccagttaaagatagaaaattacatcttggttatgtgaataagccatcccatcttttaaatgaaaatgaacataatattcctcgttgtggttgttatgattcacgttcaaatgttgctaaaccttctgaatttgatgcagaattctttaattgtcttccagaagaagctatggctcttgatccaagacatcgttggatattagaaacaagttgggaagctttagaaaattcaggtattgcaccaaattcattagaaaataccattactggtgttttccttggtataaatgatagtcatgattatcatgatttaatgaaagaaaatggtattacaccacctattgctgcccattctacaccaagtggtattgttggacgtcttagttatttctataaattatttggaccttctttcacgattgataccgcttgttctactggtgcttctgctttacattctgcctgtcgttcattacaatttggagattgtgatttatctattgtttccggtgttaaatatttatatacttcaaatgatttccatagaacaagtattgcacgtatgacttcaccaaagggaagatgtgctacttttgataaagatgctgatggatttgttccaagtgaaggatgtgttacttttattcttaaacgttatgaagatgctat

SEQ ID NO: 25622 - DNA, 771 bp, Anaeromyces robustus
  ketoacyl-synt
taaaattgctattattggtatggctttacgtttaccaggtgctattaataatgctaaatctttctggatggctttagctaaaggtaaagattgtgttactacaccagttaaagatagaaaattacatcttggttatgtggataagccttcacatcttttaggtgaaaatgaacataatattcctcgttgtggttgttatgatacacgttcaaatgttgctaaaccttctgaatttgatgctgaattctttaattgtcttccagaagaagctatggctcttgatccaagacatcgttggatattagaaacaagttgggaagctttagaaaattcaggtattgcaccaaattcattagaaaatacaattactggtgttttccttggtataaatgatagtcatgattatcatgatttaatgaaagaaaatggtattacaccacctattgctgcacattctacaccaagtggtattgttggacgtcttagttatttctataaattatttggaccttctttcactattgataccgcttgttccactggtgcttctgctttacattctgcttgtcgttcattacaatttggagattgtgatttatctattgtttcaggtgttaaatatttatatacttcaaatgacttccatagaacaagtattgcacgtatgacttcaccaaagggaagatgtgctacttttgataaagatgctgatggatttgctccaggtgaaggatgtgttacttttattcttaaacgttatgaagatgctat

SEQ ID NO: 25623 - DNA, 738 bp, Anaeromyces robustus
  ketoacyl-synt
tattattggtataggttgtcatttccctgaaggtatagaatcaaaagaagatttttggcaaatgcttgaagatgctcgttgtattaccaaagatataccaaaagaaagatgggataaagatgaatggtattctgaggaacctattcaaggtactattcaaacaaaacgtggtgcctttttaaagaatccttatctttttgataataaatatttctatatttctatgccagaagctaaagaaatgtcaccagaacaacgttggcttttagaattaactgtggaaactttagaagatgctaatataaaaccagaaactttgaaaggtactcgtactggtgtttttattggttcttctggttgtgattatttagctacacagatttctcatgctaatgatattaattctcattctcctactggatttgaactttcaattttagctaatcgtttatcctatgtatttgatttacaaggtccatcgattagttgtaatacagcatgttcttctgcgttttcagcattaaatattggtttaaatgctatgattactgatgattgtgaaatggcgcttgtagctggttctaatttcatgaattgccctggtggatttgttgctttttctcaacttcgtgtagtatcacctgatggttcttgtaaaccatttgatgaaaaagccaatggttatgctagattagaaggtgcaggtatggtattaattaaaccttatgaaaaggcagt

SEQ ID NO: 25624 - DNA, 774 bp, Anaeromyces robustus
  ketoacyl-synt
aaaaattgctattattggtatgtctttacgtttaccaggttcaattaatagtgctaaatccttctggatggctttagctaaaggtaagaattgtgttttaccacctgttaaaaatagagatttacatcatggttatgttaataaaccaagtgatcaattaaatccaggggaacataatattccatatattggttgttacgatactagatctaatgttgcaaaaccatcccaatttgatgctgaattctttaattgtttaccagatgaagcattagcacttgatccaagacatcgttgggtattagaaactagttgggaagcattagaaaatgcaggtattccaccaaattcattagaagattcacttacaggagtatttgttggtatgagtcaagatcatgaatatgctgatttattagctgaacgtaatattatagctcctattgctgctcattctaatactcaaagtggtattgcaggacgtttaagttatttctatcgtttatatggtccatcattaactatggatactgcctgttctactggtggatcagctattcatactgccgttcgttccttacaaaatagagattgtaatttatccattgtttcatgtgtaagatacatgtatacctccaagactttctataaaacatgtgctgcaagaatgacatctcctcatggacgttgtgcaacatttgataaagatgctgatggatttgcttctggtgaaggatgtgtttgtttcgttttaaaacgtttagatgatgctat

SEQ ID NO: 25625 - DNA, 783 bp, Anaeromyces robustus
  ketoacyl-synt
aattgcagttattggtatgggtattcgtttaccaggtggtattaatacccctggaaaatattggtctgctttagttagtggtagagattgtacatcaccaacaccaactaatcgtcaccttcaccactatttaaaaccaggatgtccagccaatgaattaggaccaatggaacattatatccatcgtggtggtttctatgataccactccagatgctgctccacttagtgattttgatccaacttttttcaacatttcaccattagaagctaaagctacagatccaaaatttcgttgggtttatgaaactgtttatgaagcttttcaagatgcatgtattaatatatctgaattaaatggatctcgtactagtgtttattgtactgtaggtcaaattttggattatgtttctgtagctagagctttcaacaaaagtgaaaatatgacaagtcaaactatgcatggaagtaatccttctagttgtgctggtcgtattgcttttaattatggtttcaccggtccatctgatactattgataccgcttgttcaagtggtttaaatgatgttaacaatgcttgtaaggccctttcttgtggtgatactgatttagctgttgtttcagctgttcatcaacaaattattggtactcaatttcatgttatttctgttgctcaaatggcttctcatcttggtcgttgtgctactttcgatgctgaagctgatggttatgctccaggtgaaggatgtattagtcttattcttaagcgtttagacgaagctgt

SEQ ID NO: 25626 - DNA, 780 bp, Anaeromyces robustus
  ketoacyl-synt
agttgcagttgttggtattgctttaagacttccaggtggtataaatacagttgataaatattgggatgttttagttaatggaaaattctgtgctactccaactggtactaaccgtcatcttcatcattatatgactacagctgaacatttaaaaccaggagaacattatgttactaaatattgtcgttatgatagtactccagatgcagctccaataactgattttgatccaatgttctttaatatgaatccaagtgaagctgctgctcttgatccaaaattccgttgggttttagaaactacatatgaagctttacaagatgcttgcattaatccagattctctttctggtactcgtactaatatttatactgcaccaggtcaagttcatgaaatgaataattatactactagtgcttcaccaactggttttagtgtacttaatggtcaaagtatgcatggtgttgcttgtgcttctttaccaggtagaattagttttatgtataacttatatggtgctgcccatacagttgatactgcttgttcttctggtttagttgctgctcatgatgcttttaaagatttaaatattggtgaaactgatcttgctattgttaatgccgctcattgtccatttataggtagtggtttcagtcttttatctattgctcaaatggtttctagaaattgtagatgtgctgcttatgatgaagctgctgatggttatgttccaggtgaaggttgtgttaccgtcattttaaagagaaaagatgatgctat

SEQ ID NO: 25627 - DNA, 651 bp, Anaeromyces robustus
  ketoacyl-synt
tccaaaggctcttcaatttgatcgtactgttgctgctcaaattccaacaggttggaaaccagaaacttatggtgttccaaagaatattattgatcaagttgatccaattaccctttatgttattgttgctactgtagaagcacttgttagttctggtattactgatccatatgaattctatgaatatgttcatgtttctgaagttggtaattgttctggtggtggtgttggtggtatggtttccactcataaagaatactttgatcgtgcttttgaaaaaccagttcaaagtgatattcttcaagaaagctttattaatactatgccagcttggattaatcttttattactttcttcttcaggtccaatcaagactccagttggtgcttgtgctactgctgtagaatctgtagatattggtgttgaaaccattttaagtggtaaggctaagattgttattgttggtggttatgatgatttccaagaagaaggttcttatgaatttgctcaaatgaaggctactagtaattcattagatgaattagctcatggtcgtgatccatctgaaatgtctcgtccagctactactactagatctggtttcatggaagctcaaggtgctggtcatgaaattttaatgaaagctagtct

SEQ ID NO: 25628 - DNA, 738 bp, Anaeromyces robustus
  ketoacyl-synt
aattgctattattggtgttggttgtcgtttaccaggtgatattactaccaaagaagacttttggaatatgttagttactaaacgtgttgttacatcagagattccagctgatcgttgggatcgtgaagaatggtatagtaaggaaccaatcccaggtactattcaaactaaacatggtggtttcctttctaatgcttatgactttgataataaatatttttctatttctcaagctgaagcacttgaaattactccagaacaacgttggttatgtgaacttgctgttgaaaccatggaagatgctaatatacgtccagaagaattaaagggtagtcaaacaggtgtatttgttggttcagcaggtattgattttggtggtaaccaattagtaaatacattacaaatgtctgcacacactatgactggtttagaaccatcaattttttctaatcgtatttcttacatttttgatttacatggtccatccattactagtaatacggcttgttcagcttctatgtcttcattatctatggcttgtaatgctatagcagttggtgattgtgataaggcttttgttgctggttctaatttcttacctactcctggtggttatgttgctttctcacaacttagagttgtttcaaagactggttcatgtaaaccatttgatgaaaaagctgatggttatgctagacttgaaggtgcttgtatgttattgattaaagattatgaaaa

SEQ ID NO: 25629 - DNA, 774 bp, Anaeromyces robustus
  ketoacyl-synt
aaaaattgctattattggtatggctcttcgtttaccaggtgcaattaataatgctaaatctttatggatgactttacttaaaggtaaaaattgtgttgtagccccagttaaaaatagagatttacatactaattatgttaataaaccaagtaatcaattacttccaaatgaacataatattccatattttggttgttatgatactaaatctaatgttgctaaaccttcacaatttgatgctgaattctttaattgtttaccagatgaagctttatcacttgatccaagacatcgttggattttagaaacaacttgggaagctttagaaaatgctggtataccaattaattctttaaaaaatacaactactggtgtttttgttggtattaatgatgatcatgaatattcagatttattagaagaaaatggtatttctattcctatttcttctcattctaatcatccaagtgatattgctggtcgtttaagttatttttataatttatatggtccatcttatactatggatacggcttgttctacaggtgcttcagctattcatgtagcttgtcgttccttacaaaatagagattgtaatttatgtatggttactggtgttaaatatatgtattcttcaaaatctttaagtaaagcttgttcagctagaatgatttcccctcatggtcgttgtgctacttttgatatagatgccgatggatttgtaccaggtgaaggttgtgttacatatattttaaaacgtttaaatgatgctat

SEQ ID NO: 25630 - DNA, 795 bp, Anaeromyces robustus
  ketoacyl-synt
agctattgtaggtattggattacgtctaccaggtggtattaattcaactcaaaaattttggctttctcttattaaaggaagaaattgtttatcaaatactccaactgatcgtcaattacatcaaggttttgttgatatgcaaaaaaatccaaataaaaatttagatattaatgaacattatattggtaaatatggctattatgaatctgttcgtggtaccgcaaaacccacagattttgatgcagatttttttgaatgttctaaagatgaagctattggtatggatgttaaacaacgttggatacttgaaacaagttgggaagctttagaagatgcaggtattgatccatctattattgaaaattctaatactggtatatttgtaggtatgaataattgtaatcatcacgtaaaattaatggcctctaaggaagctaccaatattaattcaaattataatagtattactactcatggaacagaattatgttctgtagcaggtcgtctttcctatttttataaattatatggacctgctatatcgattgatacagcatgttctacaggagcaacagcagtacatgttgcttgtcgttcaattcaaatgggagaatgtgatttagctattgtttcaggagctcgatatctttattataatgatgaatttattaatacatcacatgcaaaaatgacatcaccaaataatcgttgtgctacatttgatgaatcagcggatggatttgcatcttctgaaggatgtgttaccttaattcttaaaagattagatgaagcaga

SEQ ID NO: 25631 - DNA, 780 bp, Piromyces finnis
  ketoacyl-synt
aattgctgttgttggtattgcgttaagacttccaggaggtataaatactgttgacaaatactggaatagcttagttgatggtagattctgtatctcaccaattggtacaaatcgtcaccttcaccactacatgtctaaagaagaaaacttaaagccaggagaacattatatttacaactatggtcgttatgattctaccccagatgctgccccaatttctgactttgatccaatgttcttcaacatgaacccaaatgaagcctctgctcttgatccaaagttccgttgggttttagaaactacttatgaagccttccaagatgcaggtattgatccagatgtcctttctggaactaatactagtgtatacactgctccaggtcaagtcgatgaaatgaatagatatgctattcttgcttctgatactggcttcagtgttcttaatggtatgagtatgcatagttgtgctgctgcttctttacctggtagaatcagtttcatgtataatttacttggtgctgcccacaccgttgatactgcttgttcttccggtttagttgctactcatgatgccgtcaaggacttaaaccttggtgaaactgatcttgctattgttaatgccgctcactgtccattcatgagctccggtttcagtcttttatctgtcgcaaagatggtctcaagaaactgtagatgtgctgcttatgatgaagctgctgatggttatgttcctggtgaaggttgtgtcactatcattttaaagagaaaagatgatgctat

SEQ ID NO: 25632 - DNA, 774 bp, Piromyces finnis
  ketoacyl-synt
caaaattgcaattattggtatggcacttcgtttacctggtgctatcaataactcaaaatctttatggatggctttagcaaagggtaaagattgtgtattacctccagttaaaactagagatttacacactcgctatgctaataaatcagctgatcaattagaattagatgaacattatcttccacgtattggttgttatgatactcgtaatagtgttgcaaaaccatctgaatttgatgcttcatttttcaattgtttaccagatgaagcagttgccttagatccaagacatcgttggattttagaaactagttgggaagctttagaaaatgctggaattgcaccaaattcattaaaaaagactacaacaggtgttttcattggtattaacaatgagcatgagcatgaagatttattacatgattgtggtattatccccccattagcttcacatgctactgcacaaagtagtattgctggtcgtttaagttacttttatcaattatttggaccttcatatactattgatactgcatgttctaccggtagttctgcactccattctgcctgccagtcattacaatgtaatgattgtaatttatcaattgtaactggtgtaaaatatatgtattcttctaaggaattccataaaacatgctcagctcgtatgacatcaccaaatggtcgttgtgctacctttgatgctagcgctgatggatttgcccaaagtgaaggttgtgtcacatttatattaaagcgttttgatgatgctgt

SEQ ID NO: 25633 - DNA, 471 bp, Piromyces finnis
  ketoacyl-synt
agaaacaagttgggaagccttagaaaacgcaaatattgctcctaattctttagaaaactcatctactggtgttttcgtcggaattaacgatgatcatgaatactcggatttaatgactgaatgtggtattgaaacatcaatcgctagtcatggttcaagtccaagtggtatcgctggtcgtttaagttatttctatcgtttatacggcccttctttcacaattgatactgcttgctcaacaggtgctaccgcacttcacactgcttgccgttcattacaacatcatgattgtaacttatctatcgtttctggtgtcaaatatatgtattcttcaaagaacttttataaaacatgtgctgccagaatgacttcaccacatggtcgttgtgctactttcgacaaagatgctgacggtttcgttcctagcgaaggttgcgtcacttttattttaaagcgtttagacgatgctat

SEQ ID NO: 25634 - DNA, 316 bp, Piromyces finnis
  ketoacyl-synt
aaagatcgctatcatcggtatgggtcttcgtttacctggcgctattaacaatgctaaatctttatggatgtctttagctaaaggaaaggattgtgttttaccacctcttaaaaacagagacttacatcgtaattacgttaataaaccaagtgaattgttagatccatcagaacataatatccctcgtttaggtctctacgatactagatcaaatgttgcaaaaccatctcaatttgatgctgctttcttcaactgcttacctgacgaggctttatctctcgatccaaggcaccgttggatcttagaaacaagttgg

SEQ ID NO: 25635 - DNA, 738 bp, Piromyces finnis
  ketoacyl-synt
aatcgctattattggtgttggctgtcgtttaccaggtgatatatcaacaaaagaagacttttggaacatgttagttaccaaacgtgttgttacttcagaaattccatcagatcgttgggaccgtgaggaatggttcagtgaagatcctgttccaggtaccatacaaactaagtgtggtggtttcattaccaatgcttatgattttgataacaaatatttctctatttctcaagctgaagcttttgaaattactccagaacaacgttggttatgtgaacttgccgttgaaactatggaagatgctaatattcgcccagaagaattaaaaggaagtcaaactggtgtctttgttggttcagcaggtattgattttggtggtacacaattagctaatactcttcaaatgtctgctcatactatgactggtttagaaccatccattttctctaatcgtatttcttacatttttgatttacatggtccatcaattactagtaatactgcttgttctgcctctatgtcatctttatctatggcttgtaatgctattgctgttggtgattgtgacaaggcttttgttgctggttcaaactttttaccaactccaggtggttttgttgccttctctcaacttagagtcgtttctaaaaccggttcttgtaagccatttgatgaaaaggctgatggttatgctagacttgaaggtgcttgtatgcttttaattaaggattatgaaaa

SEQ ID NO: 25636 - DNA, 715 bp, Piromyces finnis
  ketoacyl-synt
accaattgccgttattggtatgggtattcgtttaccaggtggtattaatactccaaccaagtattggaatgctttagtaaatggaaaagattgtatatcaccaactccaaataatcgtcatcttcaccatttcttaagaccaaactgtccacataacgaattaggtccatatgatcattatgttcatcgtgctggttattatgatgttgttccagatgctgcaccaattactgattttgatccaactttctttaacatttctccattagaagcaaaatttactgaaccaaagtttcgttgggtctatgaaactgtttatgaagctttccaagatgcttgtatcgatatttctgagttaaatggttctcgcactggtatttattgtactgttggtggtacatttgattacattggtttaactaaggctttcgttagtggtcaaactatgacaagtcaaactatgcatggttctgctgcttctagttgtgctggtcgtatagcatttaattatggtttcattggtccatctgataccgttgatactgcttgttccagtggtttaaatgatgtcaataatgcttgtaagtctctttcttgtggtgacactgatattgctgtagcatctgctgttcaccatcaatatgttagtactcaattccatgttatctctgttgctcacatggcttctcaaactggtcgttgtgctacctttgat

SEQ ID NO: 25637 - DNA, 90 bp, Piromyces finnis
  ketoacyl-synt
tcgttgtgctacctttgatgcttccgctgatggttatgctccaggtgaaggttgtatcagtcttgttcttaagcgtttagatgacgctct

SEQ ID NO: 25638 - DNA, 738 bp, Piromyces finnis
  ketoacyl-synt
tattattggtacaggtattcgtttaccaggtgatattaataataaggatgatttctggaaggtaatgatagagaaaaaagtaattactggtcttactccagaagatcgttgggatcgtgatgaatggtattgtaagacagaaaagcccggaacaattcaaactttatatggtggttttatcgagaatgcttttgattttgataataaattcttttctatttcccaaaaagaagcattagatgctactccggaacaaagatggctttgtgaattaactgttgaaaccattgaagatgccaatattaatattgataaatttaaaggaagtaatactggtgtttttgttggtacttcaggtatagattatggtagttacgttttttcagtaccagaaaaaattacaaaatatacttatagtggaattgaaccttctattcatgccaatcgtgtttcttatcttttcgatcttcacggtccatcattatccaccaataccgcttgctcttcttcattgactgctttatccattgcttgtaattctatggccgctggtgattgtgaaatggctattgtcgctggtactaatttcttccaagctccagcaaatggtgttgcctattctcaacttcgtgttgtatcaaagaaaggcgcttgtcgtccattcgatagtggtgctgatggttatgctcgtttagaaggtgctggtatggttttattaaaaccttatgaaaaggccat

SEQ ID NO: 25639 - DNA, 660 bp, Piromyces finnis
  ketoacyl-synt
ttccatttacattccaaaggctcttcaattcgatagaactgttgctgctcaaattccaactggttggaagccagaaacttatggtgttccaaagagtattattgaccaagttgatccaataaccctttatgttattgtagctactgttgaagctttaattagttccggtattactgatccatatgaattctatgaatatgtacatgtctctgaagtcggaaactgttctggtggtggtgttggtggtatgacctctaatcataagcaatactttgatcgtgtatttgaaaaaccagttcaaagtgatattcttcaagaatgtttcattaacactatgccagcttggattaacttattattactttcttcttctggtccaattaagactccagttggtgcttgtgctactgctgtcgaatctgttgaaattggtttagaaaccattttaagtggtaaggctaaaattgttattgttggtggttatgatgacttccaagaagaaggttcatacgaattcgctcaaatgaaggctacaagtaattccttggaagaacttgctcatggtcgtgatccatcagaaatgtctcgtccagctactactacaagagctggtttcatggaagctcaaggtgctggtcatgaaattttaatgactgctag

SEQ ID NO: 25640 - DNA, 660 bp, Piromyces finnis; identical to SEQ ID NO: 25639
  ketoacyl-synt

SEQ ID NO: 25641 - DNA, 660 bp, Piromyces finnis; identical to SEQ ID NO: 25639
  ketoacyl-synt

SEQ ID NO: 25642 - DNA, 660 bp, Piromyces finnis; identical to SEQ ID NO: 25639
  ketoacyl-synt

SEQ ID NO: 25643 - DNA, 738 bp, Piromyces finnis
  ketoacyl-synt
tgtcattggtattggttgtcatttcccagaaggtattgaatcaaaggaatccttctggaaaatgttggaagatggtaaatgcattaccaaagatattccaaaggaaagatgggataaagatgaatggtattctaaagaacctgttcaaggaaccattcaaaccaaacgtggtgccttcttagagaatccatatcttttcgataacaaatatttttacatctccatgccagaagctaaggaaatgtcaccagaacaacgctggctcttagagttaaccgttgaaactcttgaagatgcaaatatcaaaccagaaactttaaagggttctcgtactggtgtttttattggatcatcaggtattgattacttagttacccaaatttctcatgctaatgatattaattcacacagtcctactggttttgagctttccattttagccaatcgtttgtcttatgtctttgatttccaaggaccatctataagttgtaatactgcatgttcatcagcattctctgctttaaacatcggtttaaatgctatgattactgatgattgtgaaatggctattgttgctggttcaaactttatgagttgcccaggtagttttgtagcttattctcaacttcgtgttgtttctaaagatggttcatgtaaaccatttgatgaaaaagctgatggttatgcaaagttagaaggtgctggtatgatattagttaaaccttatgagaaagctgt

SEQ ID NO: 25644 - DNA, 738 bp, Piromyces finnis
  ketoacyl-synt
tgtcattggtgttggttgtcgtttcccaggtaatattaaatcaaaggaagatttctgggaaatgcttactactggaagatgtcttacctctgaaactccaaaggaccgttgggattctgctgaatggtataacaaagagccaaagagaggtactgttcaaactactagaggtgcatttatggaagatgccttctactttgataataagtatttctcaatttctcaaaatgaagctaaggaaatgtcaccagaacaacgctggttattagaattagctgttgaaacctttgaagatgctaacattaatccaaagaaattaaagggttctagaactggtgtctttgtcggttcttccggtatggatttcgtagcagctcaaatttctcatgctaatgatttaactcaacactctgctactggtcttgaactttctattcttgccaaccgtatctcatactactttgatttaaatggtccatctatttgtactaacactgcatgctctgcttctatgactgccttaaatcttgctattaattccatgattactgatgattgtgatgcagctcttattgctggtactaatttattattcactccaggtagttgtgttgcatactctcaacttcgtgttgtctctgttgatggttcttgcaaaccatttgataagagggctgatggttattctcgtgttgaaggtgctggtatgttattgattaagccatatgaaaaggctgt

SEQ ID NO: 25645 - DNA, 774 bp, Piromyces finnis
  ketoacyl-synt
tagtattgctattattggtatgggtttacgtcttccaggtgctatcaatagtgacaagtctttatggtctactttagttaaaggcagagactgtattacagctattccaaaggatagaaaattacatgaaaactatgttgataagcaaagtagtgaattaaacatgggtgaacataatgttaagcgttgtggctactatgactcccgttcaagtggtaaaaagatttctcaattcgatgcagaatttttcaattgccttccggatgaagctattggtcttgatccaaagcatcgttggatcttagaaacaagttgggaagctcttgaaaatgctggtatttcacctgaatcccttgaaaataccgatacaggtgtttttgttggtattggtgatcaacaagaacatgtcaagtttatgcaagaatgtcaaaaggaaaaagttgttgcccatcacaatagtaatccatcagctattgctggacgtttaagttacttttacaaactttatggtccatctgttactgttgatacagcttgttccactggtgcaacagctcttcatactgcctgtcgttctatgattttcggtgattgtaacctttccattgtgaccgcctccaaattcttattctattcagaagaatttgaaatgacaagtaaggcaagaatgacttctccatctggtcgttgtgctacttttgataagaatgctgatggttatgtcccagctgaaggttgtgtaacctttatattaaaacgtttagaagatgctga

SEQ ID NO: 25646 - DNA, 354 bp, Neocallimastix californiae
  Ketoacyl-synt_C
tggtttaattaatgctactgctgtcggtcaaagtggttccagagcttctatgagtactccaacggttctcggtcaaaagtacattcataaaaaggtccttgaaaaggctaatcttactccaggagatattgattatatggaaggtcatggtactggtaccaaattgggtgatcgtattgaagctgaagctattaatgaagttttcaagggtactcactctgagagccgtccattaaccttagctagtgtaaagactaacattggtcacactgaagaagttagtggtttagcttctttggttaaggttttattagcaatgaagcataagaccgttcctcctcatcttcacttcaa

SEQ ID NO: 25647 - DNA, 357 bp, Neocallimastix californiae
  Ketoacyl-synt_C
tggtgttattactggtattactacttcacaatctggtattagaccatctatttcttctccagcggttggtccacaagttgagaatattcaaaaagctttacaaattgctaatgtttctccagctgatgttgattatgttgaagctcatggtactggtacccaagttggtgatgctattgaaactgaaactttaaacatagcctttggtggtactcacaatgctaagaagccattaattgtaggtagtgtaaagactaacataggtcacactgaagaagtttctggtttagctggtttatgtaaggttcttttatctatgtctcatcgtactattccaccacatcttcacttaaagaa

SEQ ID NO: 25648 - DNA, 366 bp, Neocallimastix californiae
  Ketoacyl-synt_C
ttgtgctatcgttggttgtggtagtaatgaggatggtcgttctccctccctgactatgccatcctatgaagcccaatataagcttttaagtcatgtttgtgaaaaatcaggcatacttccatcagaaattgattatgtggaggcccatggtactggtactaaagtaggagatccaattgaatcccatgccattggagatgcctatggtcgtagtaaaggggttcgtggaccaaatgatccccccgtcctcgtaagttcagtcaagggtaacacaggccatggtgaaaattcgagtggtattgttagtatcataaagacctcattgatgctccataaacgtaaattagtacccaccgttgcttatca

SEQ ID NO: 25649 - DNA, 351 bp, Neocallimastix californiae
  Ketoacyl-synt_C
ggttatcctgggttccagtagtggtcaaagtggtttaagacaatccattagtgctccttcctcggaaggtcaaagaattacgattcagagagccatgaaggtcgccggtatcactccagatcaagtctcctatgtagaggctcatggtacgggtacccccttaggggatgccatcgaggttcatgcgctcaatcaagtctacgccggtagtcacacggaagaaaatccattagttgttggtagtattaaatctaatattggtcatacctgtgaagctgctggtttagcaggtatcgctaaggttattgtggccatgaagcataatactattccaaagaatattcatttcaa

SEQ ID NO: 25650 - DNA, 408 bp, Neocallimastix californiae
  Ketoacyl-synt_C
ctgtgctattttaggtagtggtactaatgaagatggtcatactccatcattaactatgccatcttacagttctcaatgcaagttattaacacatgtttgcgaaaaatttgatattgatccagcttcaattgattatgttgaagctcatggtacaggtactgcagttggtgatccaattgaagctcgttccattggttacgcctatggtcgtagagttcgtgaaggaaagcaaattaaaactactcgtccaggtgaaactgaagaaattttagatcaacctactttcccattacttattggttcaagtaagggtaatactggtcatggtgaatattcaagtggtattattgggatgattaaggctatcttaatgttataccaccgtactatggtgccaaccattgctca

SEQ ID NO: 25651 - DNA, 348 bp, Neocallimastix californiae
  Ketoacyl-synt_C
tattcttagttctgttagtggtcaaagtggtttcagacaatccattagtgctccttcctatgaaggacaagctattaatattgaaagggcaatgaaaattgctggaatcaagccagaacaagtttcttacgttgaagctcacggtacaggtaccccattaggtgatgctattgaaattcatgctcttaataaagtttatggtggtagtcatacggaagaaaatcctttaattgtcggaagtattaaatcaaacattggccatacctgtgaagctgctggtttagccggtattgcaaaggtcatcgtttccatgaaacataatcttattccaaagaatattcatttcaa

SEQ ID NO: 25652 - DNA, 360 bp, Neocallimastix californiae
  Ketoacyl-synt_C
tgcttgtattattggtagtggtactaatgaagatggtcgtacattatctataactatgccatcctcagatgctcaatgtactttaatgaagtgggtttgtgaaaaaagtaatatcaaggcagatactattgattatgttgaagctcatggtaccggtacaccaactggtgatccaattgaagccagatctattggtaatgcctttggtaaggctgttcgtgctccaggtagtaagccacttccagttggtactgttaaaggtaacgttggccatggtgaatttttaagtggtgcaattggtctcttgaaaacttcgttaatgcttttcaataaacaattagttccaacagcagcttttga

SEQ ID NO: 25653 - DNA, 270 bp, Neocallimastix californiae
  Ketoacyl-synt_C
aagaggtgctcttgccgttttcggcttaactattgatgatattgaggcattatctttccatggtactggtacaaaggctaatgatactaatgaatccgaagtcattaacaagcaattcaaacatcttggtcgtagtaagggtaatgtttgtccagccatcatgcaaaagtacttaactggtcatccaaagggtgctgccgcttcttggatgcttaacggtatgcttcaagtcatcgaaactggtatcattccaggtaaccgtaatgccga

SEQ ID NO: 25654 - DNA, 351 bp, Neocallimastix californiae
  Ketoacyl-synt_C
agttatccttggtaccagtagtggtcaaagtggtttaagacaatcgattagtgcaccatcttctgatggtcaagtacttaacttgaagagagcacttaaatttgcaggtgttgatccatctgaagtttcttttgttgaagctcatggtactggtactccacttggtgatgccattgaagttgacgcccttaatcaagtttatggaggtagtcacaccgaagaaaatccattagtgattggtagtgtgaaaacaaacattggacatactaatgaagccgctggtttagctggtatggctaaggtcattttagccatgcaacataaatatattccaaagaatttacatttcaa

SEQ ID NO: 25655 - DNA, 360 bp, Neocallimastix californiae
  Ketoacyl-synt_C
tgccactattttaagtaccgcttgtaatgaagatggtaagacctcatccttgacaaccccatcctccgaagcgcaatgtcaactgatgaaacgtgtgtacagtaagggccacattgatccttgtaccattgattttgtggaagcccatggtaccggtacctctgttggtgatcccattgaagctcgatccatcggtgaagcctatggtaaggtgaataaggccaatggacatcctttactacccgtaggctcagtgaaaggtaatgtgggtcatggtgaatatttgagtggtatcgttggattaattaagggtgccctcatcctccacaagaataccattgttccacagaccgcgtttga

SEQ ID NO: 25656 - DNA, 357 bp, Neocallimastix californiae
  Ketoacyl-synt_C
tggtgttatcttaggaactagtagcggtcaaagtggcttccgtcaatccattagtgttccttcttttgaaggtcaagctagaaacattaagcgtgttatggaaattgctggggttaatccttccgatatctcctacgttgaaactcacggtaccggtaccccatacggtgatgccattgaaattcaaggtataaaccaggtctatgctggttcccatactcctgaacatccattagtcattggtagtatcaagaccaatattggtcataccgctgaaacctctggtttagccggaattgcaaaggttttagtggccatgaagaataagaccattccaagacaccttcacttcaagac

SEQ ID NO: 25657 - DNA, 351 bp, Neocallimastix californiae
  Ketoacyl-synt_C
tgttgttttaagtactagtagtggtcaaagtggtttaagacaatctattagtgctccatcctcagaaggtcaagctattaatatgcgtaaggctatgaagtttgctggtattaaaccagaagatgtgtcatatgttgaagctcatggtactggtacaccattgggtgatgctcttgaagttcatgccttaaacgaaatttacggtggtagtcatactgaagaaaatccacttgttgttggtagtatcaagactaatattggtcacacttgtgaaactgctggtttagctggtattgctaaggtcattgtttcaatgcaacacaaacatattccaagaaaccttcacttcaa

SEQ ID NO: 25658 - DNA, 270 bp, Neocallimastix californiae
  Ketoacyl-synt_C
aagaggagctcttgccgtctttggtttaactatggatgatattgatgctctctctttccatggtacaggtactaaggctaatgatactaatgaatcagaagttatcaacaaacaatttaaacatcttggtcgtagtaagggtaatgtttgcccagctattatgcaaaagtacttaaccggtcatccaaagggtgctgctgcttcctggatgcttaatggtatgcttcaagttatcgaaaccggtattatccctggtaatagaaatgccga

SEQ ID NO: 25659 - DNA, 357 bp, Neocallimastix californiae
  Ketoacyl-synt_C
tggtttaattaatgctacagctgtcggtcaaagtggttcaagagcttctatgagtacaccatctgctattggtcaaaagatcattcatgaagaagtcttaaagaatgccaaccttactccaaaagatattgactatatggaaggtcatggtactggtacaaaattaggagatcgtattgaaggagaagccatcaatgaagttttcaagggatctcactctgaaagtcgtccattaacattagctagcgttaagactaacattggtcacactgaagaagttagtggtttagcctctcttgttaaggtcttattagccatgaaatacaagaccattccacctcaccttcacttccataa

SEQ ID NO: 25660 - DNA, 357 bp, Neocallimastix californiae
  Ketoacyl-synt_C
tggtatacttctaggtagtagtaatggacaaagtggaggacgtcaatccatttctgttccatcttctgaagctcaagttcgtaatattaaaaatgcattaaaagatgctcatgtatctccaaaagatatatcgttcgttgaagcccatggtaccggtaccccttatggtgatgcaatagaaattcatgccttaaatcaaattttcaaagattcacattccaaaaaatcacccttatatattggaagtgtcaaaactaacataggacatacctgtgaagcagctggattagccggtattgttaaagtcttactctccatgaagcataatgtcattccaaaacatattaactttaaaaa

SEQ ID NO: 25661 - DNA, 357 bp, Neocallimastix californiae; identical to SEQ ID NO: 25660
  Ketoacyl-synt_C

SEQ ID NO: 25662 - DNA, 357 bp, Neocallimastix californiae
  Ketoacyl-synt_C
tggtattctccttggtagtagtaatggtcaaagtggaggacgtcaatcaatttctgttccttcctcagaagctcaagtacgtaatattagaaatgcactaatggatgctcaaatctctccaaaggacatttcatacattgaagcccatggtactggaactccatatggtgatgcgttggaaattcacgctttaaatcaagtttttggagaaagccatactaaaaattcaccattgtatattggtagtgtgaaaactaatataggacatacctgtgaagcagcagggttagcaggaattgttaaagttttactatccatgaaacatcaaataattccaaagcatattaattttaaaaa

SEQ ID NO: 25663 - DNA, 213 bp, Neocallimastix californiae
  Ketoacyl-synt_C
agttattcttggttcagttagtggtcaaagtggtttaagacaatcaattagcgctccttcctacgaaggtcaagctctcaacatcgaaagagcaatgaaaattgcaggtatcagtccagatcaagtatcctatgttgaagctcatggtactggtactcccttaggagatgctattgaaattcatgccctgaatgaagtctatgctggtagtca

SEQ ID NO: 25664 - DNA, 270 bp, Anaeromyces robustus
  Ketoacyl-synt_C
acgtggtgctttagccgcctttggtcttactgttgatgatattggtgttgcttccttccatggtacaggtacaaaggctaatgataagaatgaatcagatgtctttaataaacaatttgaacatttaggacgtactaaaggtaatgcttgtccagttgtatgtcaaaagtatcttactggtcatggtaagggtgctgctgctgcttggatgttgaatggtgttattcaaattattcaaactggtattattccaggtaatcgtaatgctga

SEQ ID NO: 25665 - DNA, 351 bp, Anaeromyces robustus
  Ketoacyl-synt_C
tgttatattaggtactagtagtggacaaagtggtattagacaatctattagtgccccatcttcagatggacaagttattaatttaaaaagagctcttcattttgctggtgtcgatccatccgatatttcatttgttgaaactcatggtacaggtacaccacttggggatgctattgaagttaatgctttaaatcaagtttataaaggaactcatacttctgagaatccattaattattggtagtgttaaaactaatattggtcatacaacagaagttgcaggtttagcaggtgttgctaaagttattttatctatgcaacataaatatattccaaagaatttacatttcaa

SEQ ID NO: 25666 - DNA, 351 bp, Anaeromyces robustus
  Ketoacyl-synt_C
tgttatattaggtactagtagtggacaaagtggtattagacaatctattagtgccccatcttcagatggacaagttattaatttaaaaagagctcttcattttgctggtgtcaatccatccgatatttcatttgttgaaactcatggtacaggtacaccacttggtgatgctattgaagttaatgctttaaatcaagtttataaaggaactcatacttctgaaaatccattagttattggtagtgttaaaactaatattggtcatacaacagaagttgctggtttagcaggtgttgctaaagttattttatctatgcaacataaatatattccaaagaatttacatttcaa

SEQ ID NO: 25667 - DNA, 366 bp, Anaeromyces robustus
  Ketoacyl-synt_C
ttgtgctattgttggatgtggaagtaatgaagatggtcgttcaccttcccttactatgccatcttatgaagctcaatataaacttttaactcatgtttgtgaaaaatcgggtattcatccaactcaaattgattatgtagaagctcatggtacaggtacaaaagtaggtgaccccattgaatcacgggctattggtgatgcttatggtaaaagtaaaggtattcgtggtccaaatgatccaccaattttaattagttctgttaaaggtaatacaggacatggtgaaaattctagtggtatagtaagtattattaaaacttctatgatgcttcataaacgtcgtctcgtacccactgtagcttatca

SEQ ID NO: 25668 - DNA, 351 bp, Anaeromyces robustus
  Ketoacyl-synt_C
tgttattataggtactagtagtggtcaaagtggtttaagacaatccattagtgctccatcctccgaaggacaagctataaatattaaaagagctatggaaattgcagatattaaaccagaagatgtttcctatgttgaagcccatggtacaggtacaccattaggtgatgcattagaaattcattccttaaatcaagtttatgctggtagtcataatgaagaaaatccattagttgttggtagtgttaaaactaatattggacacacaggtgaagttgccggtttagctagtattgctaaagttattttagctatgcaacataaacatattcctaagaatcttcatttcaa

SEQ ID NO: 25669 - DNA, 357 bp, Anaeromyces robustus
  Ketoacyl-synt_C
tggtgttattactggtatttctacagctcaatcaggtactagacgttctatttctactccagctgttggcccacaagcagaaaatatgagaagagttttatctatggctaatattaatgcatctgatgttgattatcttgaagctcatggtactggtactccagtaggtgatgctattgaaactgaaactttaaatcttgttttcggtaaaactcataccgaaaagaaacctttaattgttggtagtgttaagactaacttaggtcacacagaagaagtttctggtttagctggtttatgtaaagttcttttatctatgtcacatcgtataattccaccacatcttcacttaaagaa

SEQ ID NO: 25670 - DNA, 357 bp, Anaeromyces robustus
  Ketoacyl-synt_C
tggtttaattaatgctgctgctgttggtcaaagtggttccagatcttctatgagtactccaactgttgaaggtcaatctagaattcataaggaagttttaaaattagctcatcttgaaccaaaagatattgattatatggaaggtcatggtacaggtacaagtttaggtgaccgtattgaaggtgaagctattaaccttattttcaaaggtactcactctgaaactcgtccattaactttagctagtgttaaaaccaatattggtcatactgaagaagttagtggtttagcttctcttgttaaagttttattagctatgaaaaataagactgttccaccacatcttcatttccataa

SEQ ID NO: 25671 - DNA, 270 bp, Anaeromyces robustus
  Ketoacyl-synt_C
aagaggtgctcttgctgtctttggtttaactattgatgatattgatgccttatctttccatggtactggtactaaggctaatgatactaatgaatctgaagttattaataaacaatttaaacatcttggacgtagtaaaggtaatgtttgtccagctattatgcaaaagtatttaactggtcatccaaagggtgctgctgcttcatggatgcttaatggtatgcttcaagttattgaaactggtattattccaggtaatcgtaatgctga

SEQ ID NO: 25672 - DNA, 360 bp, Anaeromyces robustus
  Ketoacyl-synt_C
tgctacaattattggtagtggtaccaatgaagatggtcgtacattatctattacccttccttcctctgatgctcaatgtgctttaatgaaatgggtatgtgaaaagagtaatattaaggctgatactattgattatgttgaagctcatggtactggaactccaactggtgatccaattgaagccagatctattggtaatgcttttggtaaggttgttcgtactccaggaagtaaacctcttccagtaggtacagttaaaggtaatgttggtcatggtgaatttttaagtggtgctattggtttattaaagacttctttaatgcttttcaataagcagttagttccaactgctgcttatga

SEQ ID NO: 25673 - DNA, 351 bp, Anaeromyces robustus
  Ketoacyl-synt_C
tgttattattggtagtagtagtggtcaaagtggattaagacaatccattagtgcaccatcatcagaaggtcaagctcttaatattcgtaaagctatggaatttgctcaagttaaaccagaagatatttcttatgttgaagctcatggtacaggtaccccattaggagatgctatggaaattcatgctttaaatgaagtttatgctggtactcattcaaaagaaaatccattaattgttggtagtattaaaactaatattggtcatacttgtgaagttgctggattagcaggattagctaaagttattgtttcattacaacataaacatataccaagaaatcttcatttcaa

SEQ ID NO: 25674 - DNA, 354 bp, Anaeromyces robustus
  Ketoacyl-synt_C
tggagttattcttggatcaagtaatggacaaagtggaggaagacaatcaatttcagtaccatcatcagaagcacaagaacgtaatattcgaaatgcaatgaaaaatgcaaatgtatctcctaaagatatttcatatattgaagctcatggtactggtactccctatggagatgcattagaaattcatgctattaatcaaatatttggacatactcatactcaagattctcctctttatatcggtagtgtaaaaacaaatataggacatacatgtgaagcatcaggattagcaggacttgtaaaagttttattatccatgaaacatcaattaataccaaaacatataaatttccg

SEQ ID NO: 25675 - DNA, 357 bp, Piromyces finnis
  Ketoacyl-synt_C
tggtttaattaatgctgctgctgttggtcaaagtggttctagagcttctatgagttctccaactgttattggtcaaaccaatattcataaacaagttttaaaaaaggctggtgttaatccaagtgacattgactatatggaaggtcacggtacaggtacaaaattaggtgatcgtattgaagcagaagctatcaacaatgtctttaagggtagtcactctaaggaacgtccattagttttagctagtgttaaaactaacattggtcatactgaagaagttagtggtttagcttctcttgttaaagtattattagctatgaaaaacaagactgttgcccctcatcttcatttcaaaaa

SEQ ID NO: 25676 - DNA, 354 bp, Piromyces finnis
  Ketoacyl-synt_C
agctgttgttcttggttccgctagtggtcaaagtggtttaagacaatctattagtgctccttcttctgaaggtcagactgttagcattaagagagctatggaaaaagccggtattacaccagaacaagttagtttcgttgaagctcacggtactggtacaccattaggtgatgcacttgaagtccatgctcttaatcaagtttatggtggcagtcacactgaagaaaatccattaattgttggtagtattaagtccaatattggacacacatgtgaagctgctggtctagccagtattgctaaggttatcgttgctatgaagtataatcttattccaagaaatattcactttaa

SEQ ID NO: 25677 - DNA, 351 bp, Piromyces finnis
  Ketoacyl-synt_C
tgtcattttaagtacgagcagtggtcaaagtggcctaagacaatctattagcgctccttcctccgaaggtcaggctatcaacatgcgtaaagctatggaatttgctggtattaaacccgaagacgtttcttatattgaggctcatggtactggtactccattaggtgatgctttagaagtacatgctttgaacgaaatttatgctggaagtcatacagaagaaaatcctctcgttgttggtagtattaaaacaaatattggtcatacttgcgaaactgctggtttagctggcatcgctaaagtcattgtttctatgcaacacaaatatattccaaagaatcttcactttaa

SEQ ID NO: 25678 - DNA, 360 bp, Piromyces finnis
  Ketoacyl-synt_C
tgccactattattagtagtggtactaatgaagatggtcgtactttatctattactctgccatcttcagatgcccaatgtgccttaatgcaatgggtttgtgaaaagagtaatatcaaggctgataccattgattacgttgaagcccatggcactggtactccaactggtgatccaattgaagctagatctatcggtaatgcatttggtaaaaaggttcgttctccaaatagtaaaccacttccagttggtactgttaaaggtaatgttggtcatggtgaattcttaagtggcgctattggtttattaaaggtttctttaatgcttttcaacagacaattggttccaactgccgcttttga

SEQ ID NO: 25679 - DNA, 201 bp, Piromyces finnis
  Ketoacyl-synt_C
tggtacaccattaggtgatgctattgagactgaaacattaaataaagcttttggtggtagtcatactgaaaagaaaccattagttgttggtagtgtcaaaacaaatattggtcacaccgaagaagtatcaggtttagccggtttaactaaggttattttatccatgtctcaccgtattattccaccacatcttcatttaaa

SEQ ID NO: 25680 - DNA, 201 bp, Piromyces finnis; identical to SEQ ID NO: 25679
  Ketoacyl-synt_C

SEQ ID NO: 25681 - DNA, 169 bp, Piromyces finnis
  Ketoacyl-synt_C
tggtgttatcactggtatttctacttctcaatctggttctagaccatctatttcttctccagctatcattccacaagttatgaatatcaaaaatgctttacaaattgcaaatgttactccagaagaagttgattatgttgaagcacacggtactggtacaccattaggt

SEQ ID NO: 25682 - DNA, 276 bp, Piromyces finnis
  Ketoacyl-synt_C
tgctactattttaagtactgcttgtaatgaagatggaaaaactgcttctttaactactccatcttccaaagcccaatataaattaatgaagcgtgtttatgaaaagggtcatattgatccatgtactattgattttattgaagctcatggtactggtactgctgttggtgatccaattgaggctagttccattggtgaagcttatggtaaaattaataaagccaatggaaatccagccatcccagtcggatccgttaaaggtaatgttggtcatgg

SEQ ID NO: 25683 - DNA, 270 bp, Piromyces finnis
  Ketoacyl-synt_C
aagaggtgctcttgctgtctttggtttaactattgatgatattcaagccttatccttccatggtactagtactaaggctaacgattctaatgaatctgaagtattcaacaagcaattcaagcaccttggacgtactaagggtaatgcttgcccagttattactcaaaagtacttaactggtcatccaaagggtgctgctgcttcttggatgcttaatggtatgcttcaagttattgaaactggtattattccaggtaatcgtaatgctga

SEQ ID NO: 25684 - DNA, 270 bp, Piromyces finnis
  Ketoacyl-synt_C
acgtggtgctttagctgcctttggtcttactgttgatgatattggtgttgcttccttccacggtactggtactaaggccaatgataagaatgaatctgatgtattcaacaagcaattcgaacatcttggtcgtactaagggtaacgcttgtccagtagtttgtcaaaagtatcttactggtcacggtaagggtgctgctgctgcttggatgttaaatggtgttatccaaattcttcaaactggtattgttccaggtaaccgtaatgctga

SEQ ID NO: 25685 - DNA, 270 bp, Piromyces finnis; identical to SEQ ID NO: 25683
  Ketoacyl-synt_C

SEQ ID NO: 25686 - DNA, 270 bp, Piromyces finnis; identical to SEQ ID NO: 25684
  Ketoacyl-synt_C

SEQ ID NO: 25687 - DNA, 366 bp, Piromyces finnis
  Ketoacyl-synt_C
ttgtgcaattgttggttgtggtagtaatgaagacggtcgttccccatctcttactatgccttcctatgaagcacaatataagttattaactcatgtttgtgagaaatctggtattaatccaactcaaattgattatgttgaagcccatggtactggtacaaaggttggtgatccaattgaatcccatgctataggtgatgcttatggtagaggtaagggtattcgtggtccaaatgacccacctgtattagttagttctgtaaagggtaatacaggtcatggtgaaaattctagtggtattgtaagcattattaagacttcaatgatgctttataaacgtaaattagtaccaacggccgcctatca

SEQ ID NO: 25688 - DNA, 408 bp, Piromyces finnis
  Ketoacyl-synt_C
ttgtgctattttaggtagtagtactaatgaagatggtcataccccatctctcactatgccatcctatgattctcaatgtaaattattaactcatgtttgtgaaaaattcgacattgatccagcctcaattgattatgttgaagctcacggtactggtactgcagttggtgatccaattgaagctcgttcaataggttatgcctatggacgcagagttcgtgaaggtaaacaaattaagactactcgcccaggtgagactgaggaaattcttgatcaaccaacctatccattgatcattggatctagtaagggtaatactggtcatggtgaatattctagtggtattattggtatgattaaggctgttttaatgcttcaccatcgtactatggttccaactattgctca

SEQ ID NO: 25689 - DNA, 357 bp, Piromyces finnis
  Ketoacyl-synt_C
tggtgtaattcttggtactagtagtggtcaaagtggtttccgtcaatccattagtgttccttcatcagaaggtcaagctcgtaatattgaacgtgctatggcagttgctggtgttcaaccttctgacatatcttacattgaagcacatggtactggtacaccatatggggatgccattgaaattcaaggtattaatcaagtttatgctggaagccacacctcggaacatccattagtcatcggtagtatcaagacaaatattggacatacagctgaaactgctggtttagctagcattgccaaggttttattagctatgaagaataaaactattccaagaaatcttcatttcaagaa

SEQ ID NO: 25690 - DNA, 552 bp, Neocallimastix californiae
  KR
tacgattttaattaccggtggtcttggtggtgtcggtttcgatatttctcgctacttgatgagacaacccaaccttaaggctcttgtacttactggtcgtagaccagaaacggatgaaaaggtagccggtaagttagccgaacttcgtgccctcaatccaaagattaaaattacctatgttaccgccaatgttggttctgaaaccgagatgaagaaggtcattgacgatattaacgctggaagtccagaagaagctttagttggtgtcttccacacagccggtactaatgatgatggtttaatctttaaccaatcgtatgaacgttttgccaagttaattaatagtaagattgaaggtacactttgtattgctaagcttactaatgatttgaacttgaagttcacaatactcttctcttcgatgaccgccttctttggtaatcgtggtcaaattaactactgtaccgctaatatgtttattaataaggtctgtgactactaccgtaatcatggtcgtaaggatattctttctcttgaattggcaggttggcc

SEQ ID NO: 25691 - DNA, 579 bp, Neocallimastix californiae
  KR
taatattcttattactggtggtttaggtgatgtaagtatggatgtcgttaattctctcctagctgacaaggacagtaaattggaacacattttccttctcggtagatccagtaagactaacagtagagttattgaaaagttagctcgtattgaaaaggtaaggaaagatcatgataaaaatattcaaattgaatattattcttgtgatatttctgatgaatcctctcttgctgaagtattcaatgatattcgtaaacgtcaaggcttacaaattactggtattttccatactgctggtgtcaacagtgatgccaacttcttaagccaatcctatgaaaaattagttgaaattgctccttcaaagattattggtactcataatattatgaaactttctgaagaatttaaggatgaacttaagtttgttgtctttgtttcatccctttctgctgttagtggtaacggtggtcaaactaactatactgctgctaatatgttcattgatgcgcttgctagatattataatgaccacggaagaactaatgtcatcgccatcgaactcggtggttggaagggagc

SEQ ID NO: 25692 - DNA, 534 bp, Neocallimastix californiae
  KR
ctatttaattactggtgcttttggtggtgtcggtttaagagttgttctttggctagttagccgtggtgccaagaacattttattaaccactagtagttctgttgaaaaacaatatgaacaaccaattattagatctttattggaaaagggtattaatgtaatgattaagacctgtgatattactgatttgactagtgttcaacaattattccaacaaactactccaagaattgctggtgtcttccatttagcaaatcgctttgctccaggtttaattagtacttccgatcttgctttgcttcgtaagggcttcagtgctaaggctgaaggtgcatggaatttacacttggttactcttcaaaaggctcatcaagttcaattgtttgttgtcttttcttccattcttgatgttttaggtaatcgtggtcaaactgcttatggtgctgctaatgctttcttaagttctattgttgatcatcgtagagaaaaaggtctctctggtaattgtattgctcttccagctatgcgtggttc

SEQ ID NO: 25693 - DNA, 522 bp, Neocallimastix californiae
  KR
tttaatcactggagctttcggtggtgttggtttacgtgttgctgaatggcttcagttaagaggtgccaagaatattgttttaactacatctggtaatatagaaaagcgtaacagaaaccctattgtggaaactcttcgtagtaaaggtgtccatgtgacagttacccaatgtgacatttcaaatattcatgctgtccgtaagttattccaagaaacaacaccacaaattgctggtattttccatctagctaataaatttgctcctggattgattcaaagaacttcccttgaacaattccatgttgcttataatccaaaagcaagaggtgccttaaaccttcatttagttagtaaagattatccaatagatatgtttgttatgttttcttctgttcttgatcttttaggtaataagggccaagctgcttatggcgcagctaattccttccttggttccttagttgaacttcgtcgttcgcaaggtttatgtggttcatgcctttccttgccagcgatgaaggg

SEQ ID NO: 25694 - DNA, 528 bp, Neocallimastix californiae
  KR
ctatttagttacaggagcctttggtggtgttggtttaagagtttgtctttggatgcaacttcgtggagctcatcatcttgtattgaccacttcttctaatcctgaaagtaaaaaggatcatccgatagtgaaggccttacgtcaacgtggcgcgcaagtctcgattgttaaatgtgatatatccaagtatgatgaagtagaaaagctctttaaggaaaccagtccatccctggatggagttttccactttgctaataaatttggaccaaaacttattcgtgattctggtcttgaaagctttattgccacctatgaacctaaagctcgtggagctcttaatcttcataagattagtcaaaagggttatcctctctccacctttgtcctcttttcctctgtcctcgatcttctcggtaataccggtcaaattgcctatggtggagccaatgccttcctcggtaatcttgtatattaccgtagaagacaaggactctctggtcaatgcttctccttacccgccatgaaagg

SEQ ID NO: 25695 - DNA, 558 bp, Neocallimastix californiae
  KR
taccgtcttaattactggtggtactggtggtgttggtttcgatatctgtcgctacctcgttaaacaagctaaccttaagggtcttgtccttactggacgtcgaccagaaaccgatgaaaaggttgctggtaggttagccgaaattcgtgcccttaatccaaagattaagattacctatgtcaccgctaatgttggttctgaacaagaaatgaagaaggtctttgatgatattaactctggctctccagaagaagcccttgttggtgttatccatactgctggtaccaacgatgatggtttaatcttcaaccaatcctatgaacgtttcgcaaagttaattaacagtaagattgaaggtgctctctgcattgctaagcttacggaaggtttgaacttaaagttcaccattctcttctcctccatgacggccttcttcggtaaccgtggtcaaattaactactgtacggctaacatgttccttaacaaggtttgtcagttctaccgttcccacaacggtcgcaaggatattatgtctcttgaattagcagcctggccatc

SEQ ID NO: 25696 - DNA, 528 bp, Neocallimastix californiae
  KR
ttatttggtgaccggggcttttggtggtgttggtttaagagtttgtctttggatgcaacttcgtggagctcatcatctcgtccttactacctcctctaatcctgaaatgaagtatcatcatccaattgtgaatgccttacgtcagcgtggtgctgaagttaccattgtgaaatgtgatatttcaaagtataatgaggtggaaaaactttttaaggaaactactccagtgattgatggtgtcttccattttgctaataaattcggaccaaaattaattcgagattccaacctttcaggttttatctccacctatgagcccaaggcacgtggagcgctcaatcttcataaagttagtcaacagggttatcctctctccaacttcgttctcttctcttctgtattagatcttcttggaaataccggtcaaattgcttatggtggtgccaattctttccttggtaatcttgtctattatcgtagaagtaaaggactttcaggtcagtgcttctccttaccagcaatgaaagg

SEQ ID NO: 25697 - DNA, 579 bp, Anaeromyces robustus
  KR
taatttacttattaccggtggtttaggtgatattagtattgatatcatgaaatatttcttttctttagatcattgtaaattagatcatattttccttattggtagaagtagtaaatctagtgccaaggtcaatgataagttagctcgtcttgataaatctatgaaggataatggtaaaaatattgatattcaatactatccatgtgatatctctaatgaagctgcacttgctgaagttttcaatgatattcgtaaacgtcaaggtttacaaattaatggtattttacatactgctggtactaatagtgatgcctctttcattaatcaaacttatgataaattagttgaaattgctccagctaaaattcatggtactcataatatcattaaacttactgaagaatttaatgatgaaataaagtatattgttttattttcttccattactgctctttctggtttctcaggtcaaaccaattatactgctgttaatttattcattgataatattgctaaatattgtaaaaaccatggtagagacaatgttatgtctattgagttaactatttgggaaaatgc

SEQ ID NO: 25698 - DNA, 552 bp, Anaeromyces robustus
  KR
tactattttaattactggtggtctcggtggtgttggttatgatgtttctaaatatcttattaccaaaccaaatcttaaagctcttgttcttactggtcgtagaccagaaacagatgaaaaggttgctgctaagttaaatgatcttcgttctgctagtaaaaatgttaaaattatttatgccgttgctaatgttaattctgaagaagaaatgaaaaaattatttgatgatattgctgcttcagaaaatccattaactggtataattcatactgctggtactaatgatgatggtttaatctttaatcaatcctatgaacgttttatgaaattagttcctggtaaggtagaaggtccacttattattactaaacttactaaggatataccaaatttaaaattcactattcttttatcttctatgagtagtttctttggtaatcgtggtcaaattaattataccactagtaatgtatttattaataaactttgtcgttactaccgtgctcatggtagaaaggatatggttgctttacaattagctgcctggccatc

SEQ ID NO: 25699 - DNA, 525 bp, Anaeromyces robustus
  KR
ttatttaattactggtgcttttggtggtgttggtttacgtgttgctttatggcttcaattaagaggagctaaaaatattattttaacaacttcaggtaatgctgaaaaacgtaataaaaatccaattgttgaaggtcttcgtaataaaggtgttaatgttttagtacgtcaatgtgatatttctgatattaatgctgtacgtaaattattccaagaagctaatccaccaattgctggtatattccatcttgctaataagtttgctccaggtttaattgaaagaacttccttagaacaattccatgttgcttacaatccaaaggcaagaggtgccttaaatcttcatttagttagtaagaattatccagttgatatgtttgttatgttctcatctgtacttgatcttttaggtaataagggtcaagctgcttatggtgctgctaattccttccttggttctttagttgaacttcgtcgttctcaaggtttatgtggttcttgtctttctttaccagctatgaaagg

SEQ ID NO: 25700 - DNA, 546 bp, Piromyces finnis
  KR
tactattttaattactggtggtcttggtggtgttggttacgatatctctcgtttccttatgaaacaaccaaaccttaagggtcttgttcttactggtcgtagaccagaaactgatgaaaaggttgctgctaaattatcctccattcgtgaagttaataaggctattaaggttacctatattactgttaatgttggttctcaaactgaaatgaaagaggttattagtggtattaaggctagtggtagtaaattaactggtattattcacactgctggtgttaatgatgatggtttaattttcaaccaatcctatgaacgtttcgccaaattaattaacagtaagattgaaggttctcactgtatcgctaagattactgaaggtatgaacttggaatttattcttctcttttcttctatgacttccttctttggtaatcgtggtcaaattaactattgtgttgccaatatgtttgttaataaaattgctcactactaccgtagtcacggaagaaaggatattatcactttacaattagctgtatggcc

SEQ ID NO: 25701 - DNA, 528 bp, Piromyces finnis
  KR
atacatcattactggtgcttttggtggtgttggtttacgtgttgccttatggcttcaattaagaggtgccaaaaacattgttttaactacctctggaaatgctgccaaacgtaataagaacccaattgttgaaggtcttcgtagtaagggtgttaacgttaccgtttgtcaatgtgacatttcaaatattaatgctgttcgtaaattattccaagaaactactccacaagttggtggtattttccatcttgctaacaaattcttaccaggtttaattccaagaacttcattagaacaattccatattgcttacgatccaaaggctaaaggtgctttaaatcttcatcttgttagtaaggattacccaatagatatgtttgtcttattctcttctgtccttgatttattaggtaataagggtcaagctgcttatggtgctgctaattccttccttggttctttagttgaattccgtcgttccaaaggtttatgtggttcttgtatttctttaccagccatgaagggatc

SEQ ID NO: 25702 - DNA, 579 bp, Piromyces finnis
  KR
taatcttttaatcacaggtggtttaggtgatgttagtatggatgttattgaaaatttgttatctgataaggaaactaaacttgaccacatcttccttttgggtagatctagtaaaactagtactaaggttgaagataaattagatcgtattgaaaaaattaaaaaggccaataataagaaaactgaagttgaatactattgttgtgatatttccaatggagattcattaaatgacgtattcaatgatatccgtaagcgtcaaggtttacaaattaatggtatcttccataccgctggtactaatgatgatactttattcttaactcaaacttacgaaaagtttgaaaaattagctccagctaaggttattggtactcataatattattaagtacacagaagattttaaggatgaattaaagtttatcattttaacttcttctcttactgccctttctggtttaactggtcaaaccaattatactgctgctaacatgtttattgatgccattgctagatattgtagaaaccatggaagaaataatgttatgtctttagaactttgtggttggtctggtgc

SEQ ID NO: 25703 - DNA, 528 bp, Piromyces finnis
  KR
ctatttgattaccggtgcttttggtggtattggcttaaaagttggtctttggatgcaacttcgtggtgctcgtcatattgtattaacaacatcgtctgatccagagagtaaatataagcatccaattgttaatgctttacgtcaaaaaggtgttcatgtcaccattactaaatgtgatatttcaaagtatgatgaagttgaaaagcttttcatggaaaccacaccagcaatcgatggtgttttccatttcgctaataaattcggtccaaagcttatcagggattctagcctagatagttttaatacagcatttgaaccaaaagcaagaggtgcattaaatcttcataaaataagtcaaaaaggattctcactttcttcctttgttcttttctcctctgttttagatattcttggtaattctggtcaaatggcatatggtgctgcaaattcttaccttaataatcttatttattatagaagacgtaaaggtctttctggtcaatgcttctcattaccagccatgaaagg

SEQ ID NO: 25704 - DNA, 534 bp, Piromyces finnis
  KR
ctatcttgttactggtgcctttggtggtgttggtttaagagttgttctttggttagttagccgtggtgcaaagaaccttttattaactactagtggatcagttgaaaagcaatatgaacaaccaattattcgttctttaattgaaaagggagtcaatgttatgattaagacctgtgatatcactgattacaacaatgttcaacaattattccaacaaactcaaccaagagttgctggtgtcttccatttagctaatcgttttgctccaggtttaattagtacttctgaccttgctttacttcgtaagggctttaatgctaaggctgaaggtgcttggaacttacacaaggttactgctcaaaagcaacatcaagttcaactctttgttgtcttttcttctattcttgacgttttaggtaaccgtggtcaaaccgcctatggtgctgctaatgccttcttaagttctatcattgatcaccgtagagaaaatggtctttctggtaattgtatcgctcttccagctatgcgtggttc

SEQ ID NO: 25705 - DNA, 255 bp, Piromyces finnis
  KR
ctatttgattaccggtgcttttggtggtattggcttaaaagttggtctttggatgcgacttcgtggtgctcgtcatattgtattaacaacatcgtctgatccagagagtaaatataagcatccaattgttaatgctttacgtcaaaaaggtgttcatgtcaccattactaaatgtgatatttcaaagtatgatgaagttgaaaagcttttcatggaaaccacaccagcaatcgatggtgttttccatttcgctaa

SEQ ID NO: 25706 - DNA, 765 bp, Neocallimastix californiae
  L domain-like
agatagtaaaattgttaaagtacatatggctgatttatatttagatgataaaccaatatcagaacaattctgtcatcttaattctttaatatcattggaacttataaataatggattagctggtaatcttccagcctgtttaacttcacttaatactcttgaatatttaaatttaactggaaataaacttacaggaagtattttaagtgatattgacaaattaagaaatttaaaggaattaactctttcaaagaataatctatctggtaaattaccagaagccataggaaacattgcaagtttagaatatttatatcttgataacaatcaaattactggtatccttccaaattcacttgataacttagctagtattaaggctattgatttatcatttaatcaattctatggtagtttaccagaagaaatttataatttagaatccttagaacaattatacttaaatgataatggttttagtggtagtataagtgaagatttgggaagtttttctgttattactgaattggatataacgaataatatgttcgtaggtaaaattccagaaactattggttatcttcaaaatttggaatggctttctgttgctggtaatcaatttagtgatgaatttccagtaaatttaggaaaacttagatatcttactcatcttgatataagtgataacaacttcttaagtttaccagaatctcttaagagattaaaatacttaaattatattgatctttccgataataaaaactt

SEQ ID NO: 25707 - DNA, 759 bp, Anaeromyces robustus
  L domain-like
ccaagaaatgttgaatgactgttgtgataatttgacttttaaatgtcaagataattctattactgaaattgctcttcaaaatgcaaatttatctggttcattatcaaaaacattaggagaaatttcatctttagaaattttaaatttaagtactaatcaattaactggtagtttaccttattctattggtgaattaaatcttcttaaaacattatatttatatgataataatatttctggttctattccatcttcaattggcaatctttcagacttgaaaaaattatttttacacaataatgaaatcactggcaaaattccagaatctataggtgatatgaagaatttaattgatttaaatttaggaaacaataaaatttctggtaatattcctaaatctattggttcacttaaatccattgaagcaatttctatatcttataattctcttactggtaaaattccagattctattggtaaacttgaaaccttaagaacattaaatttagaaaataatcaattaagtagtacaattcctgaatctttaggtgatttaaagaaacttagtacattatatttaaatgataataaattatctggaagtattccttcttcatttggaaacttatcaaatatcgaagatttatatttaaacaataacaaattaagtggtatcttaccagaatctcttaataaattaactgaattacatttattatatgtaaatgataatgaaaatctttatggttatgttgttga

SEQ ID NO: 25708 - DNA, 996 bp, Piromyces finnis
  L domain-like
taatgaaaatgataaagttactgaattaaatattaatttcacaaacaaaaaaggagaaattaaagaatttccagaaagtcttcaattattaacaaatcttgaaaaatttacttttgaaggtaatagtcaaagaattgatgctttaccagatttatcttcacttgaaaacttaaaatcaataaaagtatttaataaatatattactgaatttccaaaaggccttgataaattaaaaaaattagaagaaatagatttctcttatactaatatatctgaaatcccaaaacaaatatataaaattgaaaacttaagaacattatctttattttacaacaatatttcatctccaatatcaaaggatataaaaaatcttaagaaattaaaagttttaaacctttccgataataaggtttctggaacattaccaccagaactttttgaattggaagaattagaatatttaaatttattaaacaatgaatttaaaagttcaattccagaaaacatcggaaatctaaaaaatgttaaagaaatagtatttgaaaatagtggtatcactggattcttacctgaatctcttggtgaattagaaaatttagaatacttaaaaatgagaagaaatgatgtttacggttcaattccaaaatcttttggaaatttaaaaaaaatgatttatttgcaattatacggaaataatcttaatggaactataccagaagaattaggaaatatggaaaatcttgaacaaatgcttatttcaagaaataaacttacaggaagtataccagaatcatttggtaatttaaaaaatcttaaacaactacacttatattataataatctaagtggaactgttcctcaatcacttgaaaaattagaaaagcttgaaatatttgatatttctttcaataatttcaatggtgttcttccagaattccttaatgaattaccaaaccttaaagaagtagttgcaagttttaataaagatttatatgg

SEQ ID NO: 25709 - DNA, 747 bp, Piromyces finnis
  L domain-like
tataaccaatttatatttagaaaataaacgtattaatgaaaagttctgcaaatttaatgaattaatatcattagaacttatgaataatggtttaatgggtgaaattccatcctgtattacttcattaacctcacttgaatatcttaatttaagtgataacgctcttactggaagtattccaatggatattgaaaatttaagcagtttaaaagaattaaccctttctaaaaacaatttaactggtgaattcccagaatctttgggaaacattggtagtttaactggcttgtttattgattccaatcagttatccggtgaacttccacattctcttgacaaccttttcagcattaaatcatttgatgtatcagataatcaattttctggagatctcccagaagaattttataatatgtatactttagaacatggatatttcaataataataaattcactggtagattagatagagatattggtgtcttttcagtattatctgaattagatttaacgaataataagtttgaaggcaaaattccatcatccattggtttccttcaaaatttagaatggctttcattagctggtaataaatttactggtgacttcccaagtaacattgccaaatcaaagtatttagtttacctcgatttaagtaataataaatttagtagtgttccaacggcacttaaaagattagcttatttaggttatatcgatgtatcaaacaatcctaatttaaaggg

SEQ ID NO: 25710 - DNA, 408 bp, Neocallimastix californiae
  LamGL
ttcatttactattgaagtcaatgttgttcctactggtgttcaacaattcaatatgttagcaggaaaaggtgaccgttcgatcggtttcagaacatcaacgaattctattgatttcttcatttatgcaggaaatgaatggcgtaccgttaactacaatatgggtgtagattctgcttcaggttgggtaggcagaaaacatcaagtagctggtatttatgatgctgaaaataatatgttaagagtttatgccgatggtaggatattaggtgaaagatctgtaggtacaaattcaggtgtagctcattccaattataatctcatgttaggtgcttgtccagatactggaagaaattctcaaggaaacttttatgaaatgagagtatatagtaaggctctcacagcttcaga

SEQ ID NO: 25711 - DNA, 408 bp, Neocallimastix californiae
  LamGL
ttcatttactattgaagttaatgttgttccaactggtgttcaatccttcaatatgttagccggtaagggtgattactctttaggtttcagaactactactggtgctcttgatttctttgtttatgccggtaatgaatggcgtatggttagttacactatgggtgttgatgctaattctggttggattggtaagaaacatcaagttgccggtattttcgatgctggtagtaatatgttaagattatatgttgatggtaagatggttgctgaaaagtctgttggtactacagctggtgtcagttcttccaactataatcttatgttaggtgcttgtccagatactggtagaaattcacaaggtaacttctatgaaatgagagtttatagtaaagctctttctgcttctga

SEQ ID NO: 25712 - DNA, 408 bp, Piromyces finnis
  LamGL
ttcattcaccattgaaataaatgttgttccatcaggcgtacaacaattcaatatgttcgctggaaaaggtgatcattcttttggatttagaaccaccacttcttctcttgatttctttattttcgcaggaggagaatggcgtagtctttatcatgatatgggtgttgactcatcttctggttgggttggtaaaaaacatcaagttgcaggtatttatgatgctgaaaataacatgttgagattatatgccgatggtaagatggttcgtgaaactaaaataaatacaaattctggtgtagaacattctagttataatcttatgttaggtgcctgtccagaaactggaagaaattctcaagccaaattttatgaaatgagagtttataataaggccctcaccgcctccga

SEQ ID NO: 25713 - DNA, 480 bp, Neocallimastix californiae
  Laminin_G_3
ttatatttcaggtgctttaactattcctcataacagtaagattgattctgcattagaaggtagaaattcatttactattgaagtcaatgttgttcctactggtgttcaacaattcaatatgttagcaggaaaaggtgaccgttcgatcggtttcagaacatcaacgaattctattgatttcttcatttatgcaggaaatgaatggcgtaccgttaactacaatatgggtgtagattctgcttcaggttgggtaggcagaaaacatcaagtagctggtatttatgatgctgaaaataatatgttaagagtttatgccgatggtaggatattaggtgaaagatctgtaggtacaaattcaggtgtagctcattccaattataatctcatgttaggtgcttgtccagatactggaagaaattctcaaggaaacttttatgaaatgagagtatatagtaaggctctcacagcttcagaattagc

SEQ ID NO: 25714 - DNA, 483 bp, Neocallimastix californiae
  Laminin_G_3
taattacatttctggtgctttaactattccacataatagtaaacttgattctgctcttcaaggtagaaattcatttactattgaagttaatgttgttccaactggtgttcaatccttcaatatgttagccggtaagggtgattactctttaggtttcagaactactactggtgctcttgatttctttgtttatgccggtaatgaatggcgtatggttagttacactatgggtgttgatgctaattctggttggattggtaagaaacatcaagttgccggtattttcgatgctggtagtaatatgttaagattatatgttgatggtaagatggttgctgaaaagtctgttggtactacagctggtgtcagttcttccaactataatcttatgttaggtgcttgtccagatactggtagaaattcacaaggtaacttctatgaaatgagagtttatagtaaagctctttctgcttctgaattatc

SEQ ID NO: 25715 - DNA, 483 bp, Piromyces finnis
  Laminin_G_3
taattatatctctggtgctttaactattcctcacaacagtagaattgactccgcattagaaggtaaaaattcattcaccattgaaataaatgttgttccatcaggcgtacaacaattcaatatgttcgctggaaaaggtgatcattcttttggatttagaaccaccacttcttctcttgatttctttattttcgcaggaggagaatggcgtagtctttatcatgatatgggtgttgactcatcttctggttgggttggtaaaaaacatcaagttgcaggtatttatgatgctgaaaataacatgttgagattatatgccgatggtaagatggttcgtgaaactaaaataaatacaaattctggtgtagaacattctagttataatcttatgttaggtgcctgtccagaaactggaagaaattctcaagccaaattttatgaaatgagagtttataataaggccctcaccgcctccgaattagc

SEQ ID NO: 25716 - DNA, 729 bp, Neocallimastix californiae
  LEUCINE-RICH REPEAT RECEPTOR-LIKE PROTEIN KINASE
aatatcagaacaattctgtcatcttaattctttaatatcattggaacttataaataatggattagctggtaatcttccagcctgtttaacttcacttaatactcttgaatatttaaatttaactggaaataaacttacaggaagtattttaagtgatattgacaaattaagaaatttaaaggaattaactctttcaaagaataatctatctggtaaattaccagaagccataggaaacattgcaagtttagaatatttatatcttgataacaatcaaattactggtatccttccaaattcacttgataacttagctagtattaaggctattgatttatcatttaatcaattctatggtagtttaccagaagaaatttataatttagaatccttagaacaattatacttaaatgataatggttttagtggtagtataagtgaagatttgggaagtttttctgttattactgaattggatataacgaataatatgttcgtaggtaaaattccagaaactattggttatcttcaaaatttggaatggctttctgttgctggtaatcaatttagtgatgaatttccagtaaatttaggaaaacttagatatcttactcatcttgatataagtgataacaacttcttaagtttaccagaatctcttaagagattaaaatacttaaattatattgatctttccgataataaaaactttattggtgaaattgatct

SEQ ID NO: 25717 - DNA, 720 bp, Anaeromyces robustus
  LEUCINE-RICH REPEAT RECEPTOR-LIKE PROTEIN KINASE
tgactgttgtgataatttgacttttaaatgtcaagataattctattactgaaattgctcttcaaaatgcaaatttatctggttcattatcaaaaacattaggagaaatttcatctttagaaattttaaatttaagtactaatcaattaactggtagtttaccttattctattggtgaattaaatcttcttaaaacattatatttatatgataataatatttctggttctattccatcttcaattggcaatctttcagacttgaaaaaattatttttacacaataatgaaatcactggcaaaattccagaatctataggtgatatgaagaatttaattgatttaaatttaggaaacaataaaatttctggtaatattcctaaatctattggttcacttaaatccattgaagcaatttctatatcttataattctcttactggtaaaattccagattctattggtaaacttgaaaccttaagaacattaaatttagaaaataatcaattaagtagtacaattcctgaatctttaggtgatttaaagaaacttagtacattatatttaaatgataataaattatctggaagtattccttcttcatttggaaacttatcaaatatcgaagatttatatttaaacaataacaaattaagtggtatcttaccagaatctcttaataaattaactgaattacatttattatatgtaaatgataatga

SEQ ID NO: 25718 - DNA, 966 bp, Piromyces finnis
  LEUCINE-RICH REPEAT RECEPTOR-LIKE PROTEIN KINASE
catttgtaatgaaaatgataaagttactgaattaaatattaatttcacaaacaaaaaaggagaaattaaagaatttccagaaagtcttcaattattaacaaatcttgaaaaatttacttttgaaggtaatagtcaaagaattgatgctttaccagatttatcttcacttgaaaacttaaaatcaataaaagtatttaataaatatattactgaatttccaaaaggccttgataaattaaaaaaattagaagaaatagatttctcttatactaatatatctgaaatcccaaaacaaatatataaaattgaaaacttaagaacattatctttattttacaacaatatttcatctccaatatcaaaggatataaaaaatcttaagaaattaaaagttttaaacctttccgataataaggtttctggaacattaccaccagaactttttgaattggaagaattagaatatttaaatttattaaacaatgaatttaaaagttcaattccagaaaacatcggaaatctaaaaaatgttaaagaaatagtatttgaaaatagtggtatcactggattcttacctgaatctcttggtgaattagaaaatttagaatacttaaaaatgagaagaaatgatgtttacggttcaattccaaaatcttttggaaatttaaaaaaaatgatttatttgcaattatacggaaataatcttaatggaactataccagaagaattaggaaatatggaaaatcttgaacaaatgcttatttcaagaaataaacttacaggaagtataccagaatcatttggtaatttaaaaaatcttaaacaactacacttatattataataatctaagtggaactgttcctcaatcacttgaaaaattagaaaagcttgaaatatttgatatttctttcaataatttcaatggtgttcttccagaattccttaatgaattaccaaaccttaa

SEQ ID NO: 25719 - DNA, 837 bp, Piromyces finnis
  LEUCINE-RICH REPEAT RECEPTOR-LIKE PROTEIN KINASE
gaatttaggaacaaatgattgttgtactgcttataaagattttgaatacccagtaattattaactgcaatcaaaataacgagattataaaaatacatataaccaatttatatttagaaaataaacgtattaatgaaaagttctgcaaatttaatgaattaatatcattagaacttatgaataatggtttaatgggtgaaattccatcctgtattacttcattaacctcacttgaatatcttaatttaagtgataacgctcttactggaagtattccaatggatattgaaaatttaagcagtttaaaagaattaaccctttctaaaaacaatttaactggtgaattcccagaatctttgggaaacattggtagtttaactggcttgtttattgattccaatcagttatccggtgaacttccacattctcttgacaaccttttcagcattaaatcatttgatgtatcagataatcaattttctggagatctcccagaagaattttataatatgtatactttagaacatggatatttcaataataataaattcactggtagattagatagagatattggtgtcttttcagtattatctgaattagatttaacgaataataagtttgaaggcaaaattccatcatccattggtttccttcaaaatttagaatggctttcattagctggtaataaatttactggtgacttcccaagtaacattgccaaatcaaagtatttagtttacctcgatttaagtaataataaatttagtagtgttccaacggcacttaaaagattagcttatttaggttatatcgatgtatcaaacaatcctaattt

SEQ ID NO: 25720 - DNA, 621 bp, Neocallimastix californiae
  Lipase_GDSL
tatgcctgttggtgattctatcacctttggtgaaggtgaaagaggtggatacagaaagtatctttacagtgccttaactcaaaaaggttataaaattgatatggtaggtccggaaggatctaacagtgcttcagctaatggtatacaatatgatgataataatgctggttacagtggattccaaatcaaagaaattccaggctggggtcaacaacaaggtggtgaaggaagtttatataataaacttaagagtaagaatgctgttaagcaatctcaaccagatatcattcttcttatcattggtactaatgatatgactgccaatcgttcaatggatgcttgtgccaatgatcttcgtgctctcttagattatatgcttgcagatatgccagccaatagtattatctttatgggttctattccagaatttactgcttacggtggtaatgctcaaagaattgccaattacaatggtacagttaagaaggttgctgacgaatacgctaataagggtaagaatgttagatttgctgatgttcatggttgtcttaacggtatgtctgatataggtagtgatcgacttcacccaagtggaaatggttacaaaaaaattggtaattt

SEQ ID NO: 25721 - DNA, 750 bp, Neocallimastix californiae
  Lipase_GDSL
tgtttttggtgattcttatacaactgcaactattgattattctactttacaatttaacggtcaaagcagtaataatgaagaagaaagtaaaaattggcctttgtttttagttaaaaaacgtattatgaatatgtggaattttgcttgtagtggagctgtagtagacaatgatattattcatagtaataatgcattgccaatgacagaacaatataaagcttttattttacatatgggtaaaggtggaaaacactcaaattggagaagtgatcagtcattaataggtatctggtttggtatcaatgatataatgaatagagcagataatgatattgattatgatgatgatcaatcaattataaaaagtatgtttaaaataattaataagatttatgatcttggagctcgtaattttttgattttggatgttccatctcttgaaaaacttccacatttcatatacagtcctgtaaagggattagacgaagaagtgttaaaattcaataaaatgattgcggatagtgctatgaattttcaaaaatcaaaaccagaaactaacgtttttgtatataatgcttataatgaattaaattatataatgaaaaatgaaaataaatttggtttcaccattacagttgacgattggtatcataataatgaaagaaaacttgaagatattacaaaagaatatttttggagagatggttatcatctatctaaatatgttcaagaagctttaagccaagaact

SEQ ID NO: 25722 - DNA, 771 bp, Neocallimastix californiae
  Lipase_GDSL
tatcatttttggtgattcatatactactgttggtattaacttcaataccatgaaatatactggagataatttatctggaggtaagaattggcctcaattcttaatcgatatgcacccaatgaatatgtggaattttgctattagtggtgctgttgttgacgcaaaagttgttgatggtaatcctcaatatactccaatgactgaacaatataattggttccttaaaaatatggctcctggaaagcaatttagtaattggaaaggtgaatcttctttatttgctatttggtttggtattaatgatattggtagtaaaagacgtaatgaaggtttaactagttctcaaattgatgagaaaattgccacttctatgtttaatatgattgatggtatgtataaacaaggagctagaaacttcatgttcatctttgttcctacaatagaaaaatgtccagcttattctaatggtaataatccaaatatcaaatctgatataccaaattataatagtaatcttaataaatatgcaaaaaatttccaagcttctcatccagatactaatgtctttgtttatgattcctacaatgaatttgattacattatggaaaataagtcacaatatggtattactaacattgatagtacttgtggtggtggatttggttttggttggggttggggcaatcaaaataattgtgattccaacacttacttctggaaggatgtcattcacccaactccaactgttcacaagccattagctcaagatat

SEQ ID NO: 25723 - DNA, 621 bp, Neocallimastix californiae
  Lipase_GDSL
tatgcctgttggtgattctattacctttggtatgggagaaaatggaggttatagaaaatatctttatagtgctttaactcaaaaaggttataatattgatatggtaggtccagaaggatcaagtagagctacagctaatggtatttcatatgatgataatcacgctggttatagtggattccaaatcaaggaaattcctgattggggtagacaacaaggtggtgatggtagtttatataataaacttaaaagtaaaaatgctgttaaacaagctcaaccagatattattcttcttattattggtactaatgatatgaccgctaatcgttctatggatgcttgtgcctcagatcttcgtgctcttttagattatatgcttggagatatgccatctggtggtattattttcatgggatctattcctgaatttacagcttatggtggtaatgctcaaagagttgcaaattataatggtactgttaaaaaggttgctgaagaatatgctagtaaaggtaaaaatgttagatttgcagatgttcatggtagtcttaatggtactggtgatcttggtggtgatggacttcaccctaatggaaatggttataaaaaaatgggtaactt

SEQ ID NO: 25724 - DNA, 621 bp, Anaeromyces robustus; identical to SEQ ID NO: 25723
  Lipase_GDSL

SEQ ID NO: 25725 - DNA, 762 bp, Anaeromyces robustus
  Lipase_GDSL
agttatttttggtgattcttatacaactgtttctgttgattttgaaactatgacatatactggacttaatttatcagggggtaaaaattggcctcaatttttaattgacatgcatttaatgaaaatgtggaattatgcagttggcggtgcttgtgttgacttaagtttgattaacggtgaccctgaaaatacaccaatgactgaccaatatgcttggttccttaaaaatatgtcaaaaggtaaaaaattcgcaaattgggatggtgatacttcattatttgttatatggtttggtattaatgatattaatggtatgtcaggtattgatgatgtattaaattctggaataaatgaaaaaatagctacctctatatttaatatggttgaaggaatgtataaagaaggtgctaaaaatttcttatttatttatgtaccttctcttgttaaatttccagcttatgccaatgaagatggtactggagtttataatgaaaatctttcttatgttattgatgaagttccagaatataataataatcttaatcaatatgccaaaaatttccaagaaattcatccagatactaatgtttttgtttataatgcttatgatgaatttgattatattatggaaaataaatcagaatatggtattgttaatataagagataaatgttcttatacttgtaatatgaaaacttatttctggaatgataattatcatccaacagctcatgttcataaaatattagcaaaagatattaa

SEQ ID NO: 25726 - DNA, 795 bp, Anaeromyces robustus
  Lipase_GDSL
tatttttggtgattcatatacaactgtcggtattgatttcaatactatgaagtatactggatctaatatgtctggaggtaaaaattggccacaatttttagttgatatgcatccaatgaatatgtggaattttgccattagtggtgctagtgttgatgctaaaattgttggtaatgctcaatttactccaatgactgaacaatacagttatttccaaagaaatatggcagctggtaaacaattttctggttggaaaggtgaaacttccttattctgtatttggtttggtatcaatgatcttggtgctgtaaatcataatggaggtgtaactactgctcaagttagtgaaagaattgctacatcaatgttcaatatgattgaaggtatgtacaaagaaggtggtagaaactttatgtttatttatgttccaccaattgaaaaatgtccagcttacaacagtggtcaaaattatatgaaaactgatgttccaatctataatgatatcattaacaagtatgctcaaaacttccaaaaatctcacccagatactaatatctttgtttacgattcttataatgaatttgattacattatggaaaatagaagtaaatatggtattactaatattgatggtacctgtggaggatttggtttcggtggaggttttggtggaggttttggtggtttcggtggttttggcggtggtaacggtcaacaacaatgtgactctaacacctatttctggaaggatgttattcacccaactccaactgttcataaaccattagctgaaga

SEQ ID NO: 25727 - DNA, 747 bp, Piromyces finnis
  Lipase_GDSL
tgttatctatggtgattcatacactactgtttccaccaactacaacactatggaatacactggtgaaaacttatcaaagggtaagaattggccacaacatttaattgatccaattcacccaatgaagatgtggaattttgctgctaatggtgctgttgttgatgctagaattgttggtcaatacactccaatgactgaacaatattcttacttcttaaaacatatgggtaagggtcaaaaattcaatacctggaagggagaaactacattattcacaatttggtttggtattaacgatcttttaagtaagcgtggtactggtacatctgttgatgaacaaattgctacttctatgtttgaaatgattgaaggtatgtacaatgaaggtggtagaaactttatgatcttcttcgttccagatgttagtaagagtcctctctactatggtaacgaaactcaaaagacttacattccagcatacaatcaaattcttaataagtacgctatgatgtaccaagcttctcacccagatactaacttcttcgtttacaatactttcagtgaatttgaatacattatggaaaacaaatctgaatacggtttaactaacattactgatgtttgtcaaactggttttggtttcggtggtttccaatggggaggtcaaagtaactgtgatgaaaagacttacttctgggctgataaccttcacccaagtccaaaggttcatgaagctttagcttatga

SEQ ID NO: 25728 - DNA, 747 bp, Piromyces finnis; identical to SEQ ID NO: 25727
  Lipase_GDSL

SEQ ID NO: 25729 - DNA, 747 bp, Piromyces finnis; identical to SEQ ID NO: 25727
  Lipase_GDSL

SEQ ID NO: 25730 - DNA, 540 bp, Neocallimastix californiae
  Lipase_GDSL_2
tggtgattctttaactgctggtcaatatttaccaaatgaacaagctgattcttggtctttcttattcggtaaatatatgaatgctgaaacagatattatcgctaagccaggtatttgtttatcagatattccactttatggaatggatcatggtatggaagtttcctatttcttaaatagtaatccacttgcaagatcttggggatacatttctgatgaagctcatgatttctctgagagaaaagctccagatcttatgattattttccttggtactaatgatgctggtaatgatgcaaaagttgttgctgaagattattatgaaactttaaagaaattccttactagagttagagaaatttatccagaaacaccacttgcaatcacttcacttttatatgatccaggaaactggaatgaaattcaatctaatattgtaaatgaatttgataatatttactatatctacatcaatgatccagttataaattcatcaccaaatatttacttaactaactaccatcttactcaaaagggtag

SEQ ID NO: 25731 - DNA, 585 bp, Neocallimastix californiae
  Lipase_GDSL_2
ctgttttggtgattctattactgatggtagaggtgttactaatgataagaataacagatggactgatattctcgctaccagattacaacagaatccagcaacaaaaaatattggtgtattaaaccaaggtattggtgctactactgtagctggaacttactataatccaactagtccagctggtcaagctagatttgaaaaagatgtcttgaaacaaacaaatgttaaatacttaattatcttatacggtgttaatgatattctctacaataatagtaatgctcaaactatcattaatgtttataaagatttaattaaaaaggctcacaacaatggaattaaggttttcggaggtacaattttaccattcggtaaaaacagtggtttcaactcaaataaggaaagtcaaagaacaactgttaataactggattatgaacacaccagcttctcaaggtggttttgatggttacattgactttgcttcagctgttgctgataaatctaacaaacaatggttgaatactaattggaactttgaaaatgatggtcttcatccaaatgctgttggttatgaagctatggg

SEQ ID NO: 25732 - DNA, 423 bp, Neocallimastix californiae
  Lipase_GDSL_2
tattggtgattctttaagtgcaggtcaatattgtccaaatgaagctcttgatgcttgggctttcttacttggtaaagctatgaatgttgaagtagatgttatcgctaagccaggtgcatgtttaaccgatgttcctatctatgataatgctcatggattagaatattcctattttatgactaatggaccaaatgctgaacaatttggttatgatgatgatgctgaatatgatttctctaagaggaaggcccctgaacttattattatttatatgggtaataatgatagtggtaaggaagatccaattgctcctgaagattactttgaaactttaaagaaattcattactagaataagaggtatttatccaaattcaaagattattgtcacctcagcttttgatagtagaccacactgggatac

SEQ ID NO: 25733 - DNA, 72 bp, Neocallimastix californiae
  LRR
tcttgaatatttaaatttaactggaaataaacttacaggaagtattttaagtgatattgacaaattaagaaa

SEQ ID NO: 25734 - DNA, 66 bp, Neocallimastix californiae
  LRR
tttagaatatttatatcttgataacaatcaaattactggtatccttccaaattcacttgataactt

SEQ ID NO: 25735 - DNA, 72 bp, Neocallimastix californiae
  LRR
tttggaatggctttctgttgctggtaatcaatttagtgatgaatttccagtaaatttaggaaaacttagata

SEQ ID NO: 25736 - DNA, 69 bp, Neocallimastix californiae
  LRR
tttaaaggaattaactctttcaaagaataatctatctggtaaattaccagaagccataggaaacattgc

SEQ ID NO: 25737 - DNA, 69 bp, Neocallimastix californiae
  LRR
cttagaacaattatacttaaatgataatggttttagtggtagtataagtgaagatttgggaagtttttc

SEQ ID NO: 25738 - DNA, 66 bp, Neocallimastix californiae
  LRR
tcttactcatcttgatataagtgataacaacttcttaagtttaccagaatctcttaagagattaaa

SEQ ID NO: 25739 - DNA, 69 bp, Piromyces finnis
  LRR
tttagaatggctttcattagctggtaataaatttactggtgacttcccaagtaacattgccaaatcaaa

SEQ ID NO: 25740 - DNA, 69 bp, Piromyces finnis
  LRR
attatctgaattagatttaacgaataataagtttgaaggcaaaattccatcatccattggtttccttca

SEQ ID NO: 25741 - DNA, 69 bp, Piromyces finnis
  LRR
tttagtttacctcgatttaagtaataataaatttagtagtgttccaacggcacttaaaagattagctta

SEQ ID NO: 25742 - DNA, 72 bp, Piromyces finnis
  LRR
acttgaatatcttaatttaagtgataacgctcttactggaagtattccaatggatattgaaaatttaagcag

SEQ ID NO: 25743 - DNA, 69 bp, Piromyces finnis
  LRR
tttaaaagaattaaccctttctaaaaacaatttaactggtgaattcccagaatctttgggaaacattgg

SEQ ID NO: 25744 - DNA, 72 bp, Piromyces finnis
  LRR
tttaactggcttgtttattgattccaatcagttatccggtgaacttccacattctcttgacaaccttttcag

SEQ ID NO: 25745 - DNA, 63 bp, Neocallimastix californiae
  LRR_1
tgaatatttaaatttaactggaaataaacttacaggaagtattttaagtgatattgacaaatt

SEQ ID NO: 25746 - DNA, 63 bp, Neocallimastix californiae
  LRR_1
tactcatcttgatataagtgataacaacttcttaagtttaccagaatctcttaagagattaaa

SEQ ID NO: 25747 - DNA, 66 bp, Anaeromyces robustus
  LRR_1
tttagaaattttaaatttaagtactaatcaattaactggtagtttaccttattctattggtgaatt

SEQ ID NO: 25748 - DNA, 66 bp, Anaeromyces robustus
  LRR_1
taaaacattatatttatatgataataatatttctggttctattccatcttcaattggcaatctttc

SEQ ID NO: 25749 - DNA, 66 bp, Anaeromyces robustus
  LRR_1
aagaacattaaatttagaaaataatcaattaagtagtacaattcctgaatctttaggtgatttaaa

SEQ ID NO: 25750 - DNA, 69 bp, Piromyces finnis
  LRR_1
tttagaatacttaaaaatgagaagaaatgatgtttacggttcaattccaaaatcttttggaaatttaaa

SEQ ID NO: 25751 - DNA, 66 bp, Piromyces finnis
  LRR_1
agaatatttaaatttattaaacaatgaatttaaaagttcaattccagaaaacatcggaaatctaaa

SEQ ID NO: 25752 - DNA, 63 bp, Piromyces finnis
  LRR_1
agtttacctcgatttaagtaataataaatttagtagtgttccaacggcacttaaaagattagc

SEQ ID NO: 25753 - DNA, 114 bp, Piromyces finnis
  LRR_4
aaacttaagaacattatctttattttacaacaatatttcatctccaatatcaaaggatataaaaaatcttaagaaattaaaagttttaaacctttccgataataaggtttctgg

SEQ ID NO: 25754 - DNA, 147 bp, Piromyces finnis
  LRR_4
aaatcttgaacaaatgcttatttcaagaaataaacttacaggaagtataccagaatcatttggtaatttaaaaaatcttaaacaactacacttatattataataatctaagtggaactgttcctcaatcacttgaaaaattagaaaa

SEQ ID NO: 25755 - DNA, 114 bp, Piromyces finnis
  LRR_4
tgaattagatttaacgaataataagtttgaaggcaaaattccatcatccattggtttccttcaaaatttagaatggctttcattagctggtaataaatttactggtgacttccc

SEQ ID NO: 25756 - DNA, 72 bp, Neocallimastix californiae
  LRR_6
tcaaaatttggaatggctttctgttgctggtaatcaatttagtgatgaatttccagtaaatttaggaaaact

SEQ ID NO: 25757 - DNA, 180 bp, Neocallimastix californiae
  LRR_8
aaatttaaaggaattaactctttcaaagaataatctatctggtaaattaccagaagccataggaaacattgcaagtttagaatatttatatcttgataacaatcaaattactggtatccttccaaattcacttgataacttagctagtattaaggctattgatttatcatttaatcaatt

SEQ ID NO: 25758 - DNA, 177 bp, Anaeromyces robustus
  LRR_8
gaaaaaattatttttacacaataatgaaatcactggcaaaattccagaatctataggtgatatgaagaatttaattgatttaaatttaggaaacaataaaatttctggtaatattcctaaatctattggttcacttaaatccattgaagcaatttctatatcttataattctcttac

SEQ ID NO: 25759 - DNA, 177 bp, Anaeromyces robustus
  LRR_8
acttagtacattatatttaaatgataataaattatctggaagtattccttcttcatttggaaacttatcaaatatcgaagatttatatttaaacaataacaaattaagtggtatcttaccagaatctcttaataaattaactgaattacatttattatatgtaaatgataatgaaaa

SEQ ID NO: 25760 - DNA, 177 bp, Piromyces finnis
  LRR_8
aatatcattagaacttatgaataatggtttaatgggtgaaattccatcctgtattacttcattaacctcacttgaatatcttaatttaagtgataacgctcttactggaagtattccaatggatattgaaaatttaagcagtttaaaagaattaaccctttctaaaaacaatttaac

SEQ ID NO: 25761 - DNA, 81 bp, Anaeromyces robustus
  LRR_SD22
aaatcttcttaaaacattatatttatatgataataatatttctggttctattccatcttcaattggcaatctttcagactt

SEQ ID NO: 25762 - DNA, 81 bp, Anaeromyces robustus
  LRR_SD22
aaagaaacttagtacattatatttaaatgataataaattatctggaagtattccttcttcatttggaaacttatcaaatat

SEQ ID NO: 25763 - DNA, 81 bp, Anaeromyces robustus
  LRR_SD22
gaagaatttaattgatttaaatttaggaaacaataaaatttctggtaatattcctaaatctattggttcacttaaatccat

SEQ ID NO: 25764 - DNA, 72 bp, Neocallimastix californiae
  LRR_TYP
aagaaatttaaaggaattaactctttcaaagaataatctatctggtaaattaccagaagccataggaaacat

SEQ ID NO: 25765 - DNA, 72 bp, Neocallimastix californiae
  LRR_TYP
tagatatcttactcatcttgatataagtgataacaacttcttaagtttaccagaatctcttaagagattaaa

SEQ ID NO: 25766 - DNA, 75 bp, Neocallimastix californiae
  LRR_TYP
agaatccttagaacaattatacttaaatgataatggttttagtggtagtataagtgaagatttgggaagtttttc

SEQ ID NO: 25767 - DNA, 72 bp, Neocallimastix californiae
  LRR_TYP
tgcaagtttagaatatttatatcttgataacaatcaaattactggtatccttccaaattcacttgataactt

SEQ ID NO: 25768 - DNA, 75 bp, Anaeromyces robustus
  LRR_TYP
aaatcttcttaaaacattatatttatatgataataatatttctggttctattccatcttcaattggcaatctttc

SEQ ID NO: 25769 - DNA, 72 bp, Anaeromyces robustus
  LRR_TYP
atcaaatatcgaagatttatatttaaacaataacaaattaagtggtatcttaccagaatctcttaataaatt

SEQ ID NO: 25770 - DNA, 72 bp, Anaeromyces robustus
  LRR_TYP
ttcatctttagaaattttaaatttaagtactaatcaattaactggtagtttaccttattctattggtgaatt

SEQ ID NO: 25771 - DNA, 72 bp, Anaeromyces robustus
  LRR_TYP
tgaaaccttaagaacattaaatttagaaaataatcaattaagtagtacaattcctgaatctttaggtgattt

SEQ ID NO: 25772 - DNA, 72 bp, Anaeromyces robustus
  LRR_TYP
aaagaaacttagtacattatatttaaatgataataaattatctggaagtattccttcttcatttggaaactt

SEQ ID NO: 25773 - DNA, 75 bp, Anaeromyces robustus
  LRR_TYP
gaagaatttaattgatttaaatttaggaaacaataaaatttctggtaatattcctaaatctattggttcacttaa

SEQ ID NO: 25774 - DNA, 72 bp, Piromyces finnis
  LRR_TYP
aaaaaaattagaagaaatagatttctcttatactaatatatctgaaatcccaaaacaaatatataaaattga

SEQ ID NO: 25775 - DNA, 72 bp, Piromyces finnis
  LRR_TYP
aaaaaatcttaaacaactacacttatattataataatctaagtggaactgttcctcaatcacttgaaaaatt

SEQ ID NO: 25776 - DNA, 75 bp, Piromyces finnis
  LRR_TYP
taagaaattaaaagttttaaacctttccgataataaggtttctggaacattaccaccagaactttttgaattgga

SEQ ID NO: 25777 - DNA, 69 bp, Piromyces finnis
  LRR_TYP
agaaaagcttgaaatatttgatatttctttcaataatttcaatggtgttcttccagaattccttaatga

SEQ ID NO: 25778 - DNA, 72 bp, Piromyces finnis
  LRR_TYP
ggaaaatcttgaacaaatgcttatttcaagaaataaacttacaggaagtataccagaatcatttggtaattt

SEQ ID NO: 25779 - DNA, 399 bp, Anaeromyces robustus
  LYSOPHOSPHOLIPASE-RELATED
gagtccattacttctttctttacacggtatggaccaagatccaaattaccaacaatccaatacccactgggaaactttagctgatactgaaggttttgttgttgtatatccaagaggaggaactggtatgagtacttgggatatccaaggtgataaggataccaaatgggtattacaaattattgatcaaatggctaaggattatgacattgaccgtaatcgtgtttacctttctggattctctatgggtggtatgttcacttaccatgctatgagtaagattggtgacaagattgctgcttttgctccatgttctggtccaaatgtatttggtgcctcaaaggctatgcgtccagttccaattttccatgttcacggtactaacgatgatgtattaaa

SEQ ID NO: 25780 - DNA, 10819 bp, Neocallimastix californiae; identical to SEQ ID NO: 23131
  MALONYL COA-ACYL CARRIER PROTEIN TRANSACYLASE

SEQ ID NO: 25781 - DNA, 9951 bp, Neocallimastix californiae; identical to SEQ ID NO: 23132
  MALONYL COA-ACYL CARRIER PROTEIN TRANSACYLASE

SEQ ID NO: 25782 - DNA, 7233 bp, Neocallimastix californiae; identical to SEQ ID NO: 23133
  MALONYL COA-ACYL CARRIER PROTEIN TRANSACYLASE

SEQ ID NO: 25783 - DNA, 11871 bp, Neocallimastix californiae; identical to SEQ ID NO: 23134
  MALONYL COA-ACYL CARRIER PROTEIN TRANSACYLASE

SEQ ID NO: 25784 - DNA, 8676 bp, Neocallimastix californiae; identical to SEQ ID NO: 23135
  MALONYL COA-ACYL CARRIER PROTEIN TRANSACYLASE

SEQ ID NO: 25785 - DNA, 11889 bp, Anaeromyces robustus; identical to SEQ ID NO: 23136
  MALONYL COA-ACYL CARRIER PROTEIN TRANSACYLASE

SEQ ID NO: 25786 - DNA, 11301 bp, Anaeromyces robustus; identical to SEQ ID NO: 23137
  MALONYL COA-ACYL CARRIER PROTEIN TRANSACYLASE

SEQ ID NO: 25787 - DNA, 11268 bp, Piromyces finnis; identical to SEQ ID NO: 23138
  MALONYL COA-ACYL CARRIER PROTEIN TRANSACYLASE

SEQ ID NO: 25788 - DNA, 11265 bp, Piromyces finnis; identical to SEQ ID NO: 23139
  MALONYL COA-ACYL CARRIER PROTEIN TRANSACYLASE

SEQ ID NO: 25789 - DNA, 11268 bp, Piromyces finnis; identical to SEQ ID NO: 23140
  MALONYL COA-ACYL CARRIER PROTEIN TRANSACYLASE

SEQ ID NO: 25790 - DNA, 11265 bp, Piromyces finnis; identical to SEQ ID NO: 23141
  MALONYL COA-ACYL CARRIER PROTEIN TRANSACYLASE

SEQ ID NO: 25791 - DNA, 345 bp, Neocallimastix californiae
  MaoC_dehydrat_N
tgttagtgaaccaattactagacaacaaattaccgatttcgtcaacattattggtaatcgtgctgaatcttacactgaccgtggtcaaaaggtcttatttgctccaatggatttcgctattgttgttggttggcagagtattatccgtgctatcttcccaaaattcatcaatgccgatttattaaagttggttcatttaactaacggattccgtatgattgataatgaatctggtttaaaggaaggtgatattgttaagactgaatctcgtattattagtgttattaatgatgaaactggtaagattgttgaagttaagggtgtcttaaagcgtgatgaaaagcc

SEQ ID NO: 25792 - DNA, 345 bp, Neocallimastix californiae; identical to SEQ ID NO: 25791
  MaoC_dehydrat_N

SEQ ID NO: 25793 - DNA, 348 bp, Neocallimastix californiae
  MaoC_dehydrat_N
cagtgttagcgaacccattaccagacaacaaattaccgatttcgttaatattattggtaatcgtgctgaatcctacactgaccgtggtcagaaggttttatttgcaccaatggatttcgctatcgttgttggttggcaaagtattatccgtgctatcttcccaaaattcatcaatgccgatttattaaaattggttcacttatctaacggtttccgtatgattgataatgaattaggattaaaggaaggtgatgtcgttaagactgaatctcgtattattagtgttgtcaatgatgaaactggtaagattgttgaagttaagggtgtcttaaagcgtgatgaaaagcc

SEQ ID NO: 25794 - DNA, 372 bp, Anaeromyces robustus
  MaoC_dehydrat_N
aactgaattcccaaaagaacgtttccaatatagtgaaagagatgttattttatattctcttggtgttggtattactaagaaagaactttcttatgtttatgaaaattcaccagatttcaaggttcttccaaccttttcaacggttccagctatggattatttctcaaaaatgaatcttgctaatgtattacctgttttctcaccagaatctttaatacaaactaaacattatatggaattaaataaaattttcgaaccaaaagattgtgttgtttctactggtaaaattgttgatattataaaaactaaaatgggtgctgtattaattactgctattaccacttacgatcaagatggtaatgaaatttgtta

SEQ ID NO: 25795 - DNA, 342 bp, Anaeromyces robustus
  MaoC_dehydrat_N
tagtgaaccaattactcgtcaacaaattaccgattttgttaatattattggtaatcaagctgaatcttacactgatcgtggtcaaaaggtcttatttgctccaatggatttcgctattgttgtaggttggcaaagtattattcgtgccatcttccctaaatttattgatgctgatttattaaaattagttcatttatctaacggtttccgtatgattgaaaatgaaactggtttaaaggaaggtgatgttgttaagactgaatctcgtattattagtgttgttaatgatgaaactggtaagattgtagaagttaagggtgtcttaaaacgtgatgaaaaacc

SEQ ID NO: 25796 - DNA, 336 bp, Piromyces finnis
  MaoC_dehydrat_N
tagtgttagtgaaccaattactagacaacaaattactgattttgttaatattattggtaaccaagctgaatcctacaccgaccgtggtcaaaaggttttatacgctccaatggatttcgctattgttgttggttggcaaagtataattcgtgccattttcccaaagtttattaatgctgatttattaaagttagttcatctttctaacggtttccgtatgattgataatgctactggtttaaaggaaggtgatattgttaagactgaatctcgtattattagtgttattaatgatgaaaatggtaagattgttgaagttaagggtgttcttaagcg

SEQ ID NO: 25797 - DNA, 336 bp, Piromyces finnis; identical to SEQ ID NO: 25796
  MaoC_dehydrat_N

SEQ ID NO: 25798 - DNA, 336 bp, Piromyces finnis; identical to SEQ ID NO: 25796
  MaoC_dehydrat_N

SEQ ID NO: 25799 - DNA, 336 bp, Piromyces finnis; identical to SEQ ID NO: 25796
  MaoC_dehydrat_N

SEQ ID NO: 25800 - DNA, 354 bp, Neocallimastix californiae
  MaoC_dehydratas
tattccaaagagaaaacctgatgctattgttaaagaacgtacttctgaagatcaagctattctttatcgtttatctggtgataagaatccattacatgttgatccagctatggcttctattgccggttaccattcaccagttttacaaagtctttgtgttttagctatcagtactcttcatatcattcaaaccttctgttatggtgatgtcgccagtattaaatctattcaagctgattttgtttcacatgtattcccaggtgaaactttacaaactaatatgtggcaagatggtacaaagattttattcaatgttaaggccttagaaagagatgttattgttatctctaatgc

SEQ ID NO: 25801 - DNA, 354 bp, Neocallimastix californiae
  MaoC_dehydratas
tattccaaagagaaaaccagatgctattgttaaggaacgtacttctgaagatcaagcaattctttaccgtttatctggtgaaaaaaatccattacatgttgatccagctatggcttctattgctggttatcattccccagttttacaaagtctttgtgttttagctatcggtacactacatattattcaaaccttctgttatggtgatgttgccagtgttaaatcaattcaggcagatttcgtttcacatgtattcccaggtgaaactttacaaactaatatgtggcaagatggtactaaaattttatttaatgttaaagctttagaaagagatgtcattgttatctctaatgc

SEQ ID NO: 25802 - DNA, 315 bp, Neocallimastix californiae
  MaoC_dehydratas
acgtgctccaaacactaatgaagattactctcttgcctctggtgatgtaaatccaattcacactaactactactttgctaacttggctgatcttgatgttccaattactcacggtatgtggactagtgctgctactcgtcgttatgttgaaacctatgccgctgataatgatgctgaacgtgtcgtttcctacaaggttaactttataggtatggtttctccaaaggatgaacttcgtaccagccttactcatgttggtatgcacaatggtagaaagatcattaaggtttccgtcaaggacttacgtactaacga

SEQ ID NO: 25803 - DNA, 291 bp, Neocallimastix californiae
  MaoC_dehydratas
tcactcctctaacattggatactcccgtgtctccggtgatgttaatccaattcatactaacccatactttgctcaattagctgatcttccaggtaacattactcacggtatgtggactagtgcctctactcgtaagtttgttgaaacctttgctgctgaaaaccatccacatcgtgttacctcttatgaagttaaattcttagatatggtcttcccaggtgatcgtttagaaaccaagcttttccatactggtatggctaatggtaagaaaattattcaatgtaagacgat

SEQ ID NO: 25804 - DNA, 291 bp, Neocallimastix californiae; identical to SEQ ID NO: 25803
  MaoC_dehydratas

SEQ ID NO: 25805 - DNA, 291 bp, Neocallimastix californiae
  MaoC_dehydratas
tcactcttccaacttaggatactctcgtgtttccggtgatgttaacccaatacacactaatccatactttgctcaattagctgatcttccaggtaacattactcacggtatgtggactagtgcttccactcgtaagtttgttgaaacctttgctgctgaaaaccatcctcaccgtgtaacttcctatgaagttaaattcttagatatggtattcccaggtgatcgtttagaaactaagctcttccatactggtatggctaacggtaaaaaaattattcaatgtaagacgat

SEQ ID NO: 25806 - DNA, 315 bp, Neocallimastix californiae
  MaoC_dehydratas
acgtgctccaaacactaacgaagattactctcttgcctctggtgatgttaatccaattcacaccaactactactttgctaacttggctgatcttgatgttccaattactcacggtatgtggactagtgccgctactcgtcgttacattgaaacctatgccgctgataatgatgctgaacgtgtcgtttcctacaaggttaactttattggtatggtttctccaaaggatgaacttcgtaccagccttactcatgttggtatgcacaatggtagaaagatcattaaggtttccgttaaggacttacgtactaacga

SEQ ID NO: 25807 - DNA, 351 bp, Anaeromyces robustus
  MaoC_dehydratas
cccaaaaagaaaaccagatgctattgtaaaagaacgtacttctgaagatcaagctattctttatcgtttatctggtgataagaatccattacatgttgatccagctatggcttccattgcaggttatcattctccagttttacaaagtttatgtgttttagctattagtactcttcatattattcaaaccttctgttatagtgatgttgctagtattaaatctgttcaagctgattttgtttcacatgtattcccaggtgaaactttacaaactaatatgtggcaagatggtactaaaattttattcactgttaaagctttagaaagagatgttattgttatttccaatgc

SEQ ID NO: 25808 - DNA, 315 bp, Anaeromyces robustus
  MaoC_dehydratas
acgtgctccaaataccaatgaagattattctcttgcctctggtgatgttaatccaattcacaccaactattactttgctaatttagctgatcttgatgttccaattactcatggtatgtggactagtgctgctacccgtcgttatgttgaaacctatgctgccgataatgatgctgaacgtgtcgtttcctacagagttaactttattggtatggtatcaccaaaggatgaacttcgtactagtcttactcatgttggtatgcataatggtcgtaagattattaaggtttccgttaaggatttacgtaccaatga

SEQ ID NO: 25809 - DNA, 291 bp, Anaeromyces robustus
  MaoC_dehydratas
tcactcctctaaccttggttattcacgtgtttctggtgatgtcaatccaattcatactaatccatactttgctcaattagctgatcttccaggtaacattactcatggtatgtggactagtgcttctactcgtaagtttgttgaaactttcgctgctgaaaatcatccacatcgtgttacttcttatgaagttaaattccttgatatggttttaccaggtgatcgtttagaaactaaacttttccatactggtatggctaatggtaagaagattattcaatgtaagaccat

SEQ ID NO: 25810 - DNA, 291 bp, Piromyces finnis
  MaoC_dehydratas
tcactcctctaaccttggatactctcgtgtatcaggtgatgttaacccaatccacactaatccatactttgctcaattagctgatcttcctggtaatattactcatggtatgtggactagtgcctctactcgtaagtttgttgaaacatttgctgctgaaaatcatccacaacgtgttacttcttatgaagttaatttcttagatatggttttcccaggtgatcgtttagaaactaaactttaccatactggtatggctaatggtaagaagattattaaatgtaaaactat

SEQ ID NO: 25811 - DNA, 291 bp, Piromyces finnis; identical to SEQ ID NO: 25810
  MaoC_dehydratas

SEQ ID NO: 25812 - DNA, 291 bp, Piromyces finnis; identical to SEQ ID NO: 25810
  MaoC_dehydratas

SEQ ID NO: 25813 - DNA, 291 bp, Piromyces finnis; identical to SEQ ID NO: 25810
  MaoC_dehydratas

SEQ ID NO: 25814 - DNA, 348 bp, Piromyces finnis
  MaoC_dehydratas
tccaaagagaaagccagacgctattgttaaggaacgtacttctgaagatcaagccattctttaccgtttatctggtgaaaagaacccattacacgttgatccagctatggcttccattgctggttacaattcaccagttttacaaaacctttgtgttttagccatcagtactcttcatgtcattcaaaccttctgttatagtgatgttgctagtgttaagtctattcaagctgactttgtttctcatgtcttcccaggtgaaactttacaaactaatatgtggcaagaaggtaccaagatcttatttaccgtcaaggctttagaaagagatattgttgttatttctaa

SEQ ID NO: 25815 - DNA, 939 bp, Neocallimastix californiae
  Metallo-dependent phosphatases
cagatttgttttccttggagatccacaaatcggtgcatccaaaaataacttttcagttttaacggagcaacgtcttactgaggaagaaggtcttagaaatgatgctttcaattggaatatgactatatataattcttatgcaaaagcaaatgaagcaagtattattttatctgctggtgataatgctgattctggtcaatctccaggtgattctagcggtaaaactgaagaatatattagaaatgatcttctcagacaagaaagagaatattcaaccttattacttcctaaattaatgcaacaggttccatttgctccagctgttggtaatcatgaatcttttactccttcttttagataccattttaatactccaaatccataccttataggtaaaactgaaacaagtcctggttatagttatttctttaaacataataatgtacttgttatcgttctcgaaactaattatggtaccgaggaagaatttagagaagtagtaggaaaagctaattcaacttttccagatgttgattggagagttgctttattccatcatgatatttatagtaatggttatacacattcacaagatcctttaattaccgaatatatacgtaaagaagtaactcaattgtttgatatatatgatattgatcttgttattaatggtcatgatcatatgtatgctgcaagtcattttattacttatgatgaaagtagaaaagaaggatataaagttgatgaggttgaaaaaaataaagtttacagtagtcataaaggtacaatgtatcttactgctaactgttctactggtagtaaactttatggtattataaatgatagagcctttgattatatttattattctaatcaaacgtttacctctactttcggtattttagattttactaataataatggtaaaacacaaatggt

SEQ ID NO: 25816 - DNA, 138 bp, Neocallimastix californiae
  Metallo-dependent phosphatases
aactttattcattactgctaactgctcttctggaagcaaatttttagattttgaagattcaagttttgattatgtttatcaatttaatcaaacttttacttcaactttcggtgtattagattttaaaaatgaatccgg

SEQ ID NO: 25817 - DNA, 672 bp, Neocallimastix californiae
  Metallo-dependent phosphatases
caaatttgtatttgtcggagatccacaaattggaggttccgtttctagagttggttatcatacttctaaaacttttgattattcagaagctgtaagaaatgacgcttttaattggaacgttactgttaatagtttctttaaaaaaacgggtaatccaagtcttttattatccgctggtgatcaagctgatactatgggtgaagatgaatcacaagaacaacaatattctggtcttcttcttccagaattaattaaaaccataccaattgctccagctcttggtaatcatgaagtatactctgaaagttttagacatcacttcaatgttccaaatccatacaaaccaaagaaattggatactttatcacgtatttcagcctataattattatttcaaatataataatgttcttgtcgttgttcttgaatccaatcataatacttgccatgattgtgaaatggttatttcaaatgctatagatgaatatccggacactgattggcgtattgctttattccatcatgatctttatggtaacggaaaaactcactctcaaggtagtagtgacggtaaaagattacgtgcttgcttaactggactttttgatatttataactttgatcttgttattaatggtcatgatcacgtttacacctctactcactttattac

SEQ ID NO: 25818 - DNA, 114 bp, Neocallimastix californiae
  Metallo-dependent phosphatases
aacgttatatattactgctaattgttccactggtagtaagctttacaataccaaaggaaataaagattatctttactattataatcaaactttcacttcaacctttggtatttt

SEQ ID NO: 25819 - DNA, 705 bp, Neocallimastix californiae
  Metallo-dependent phosphatases
tagatttattttccttggtgacccacaaattggtgcttctgctggtgccatctctgaacttcatcttaataaagttctttctgacgatgaaggtctcagaaatgatgccttcaattggaatatgactatttataattcctatgaaaaagcaaatggacctagtcttatcctttctgctggtgataatgccgattctggtcaatcaccaagtaatgaaaatagtaaaatcgaagatattaaaaaagatcttattagacaagaaaagcaatattctgctcttttacttccaagtttaatgcaaaaagttccatttgccactgctcttggtaatcatgaatcctattctccttccttcaaatatcactttaataatccaaacccttataaggtagaaagatcagaatttagtccaggctataactatttcttcaaatataataatgcccttgttgttatgcttgaatctaactatggtattaaagatgattattcagatgtcatttctaatgccacttctacttatccagatactgattggagaattgctgtattccatcatgatatctacagtaatggtgttatgcattccagtgaatacagagttactgaattacgtaagtggttaaccccattgtttgatgaatatgattttgatcttgttattaacggtcatgatcatatgtattctgccagtcaattcgttca

SEQ ID NO: 25820 - DNA, 123 bp, Neocallimastix californiae
  Metallo-dependent phosphatases
tacattctttataacagctaattgttcaacaggaagtaaattcttttcttttgataagggaacttttgattatgtttataattataatcaaacttatacttcaacctttggtgtaatggattt

SEQ ID NO: 25821 - DNA, 681 bp, Neocallimastix californiae
  Metallo-dependent phosphatases
caattttatttttgttggtgatccacaaattggtggttcaaacgatcgtattatctatgattcaagagaaagccaaggttattctttagctattaaaaatgatgcttttaattggaatatgacaatttatagttcttttgaaatgacaaaaaatccaagtcttttattatctgctggtgataatgctgataccgaaaattattatagcagtatagattattacaatcaagaatctgaatattctgcttttcttcttcctgaattaataaaaactattccaatagctccagctcttggtaaccacgaaacaaaaactgaaggttataaataccatttcaatccaccaaatacttactctacaaaaagatttgaacaaatgagtttagtaccagcatacagttatttctttaaatataacaatgttcttgtcgttgttttagaatctaataaaagtagctgtattgattgtgaaataatcttttcaaaagcagtaaaaaagtatccagatactgattggcgtattgctttgttccatcatgatgtttatggtaatggtaaaactcactcccaaggggatgctttaagattacgtccatgcttaactggtcttttcagtatctataaatttgatgttgtaattaatggacatgatcatgtctatacaacaacaaagtttgttgc

SEQ ID NO: 25822 - DNA, 912 bp, Neocallimastix californiae
  Metallo-dependent phosphatases
cagatttgtttttcttggtgatccacaaattggttcatctcgtggtagttattcaattggtaatcgtaaacaatttagtgatgatgaaggtcttagaaacgatgcttttaattggaatatgactatattcaattcttattcaaaagcaaatgaagctagtcttattttatccgctggtgataatgctgattctggtgaaacgccaagtaatggtgatattttagataatattagtaatattagtaaaatgtccactgatcttctcagacaagaaaaagaatattcatctttattacttccagaattaatgcaaaaagttccatttgttcctgctgttggtaatcatgaatcttatactgctacatatagatatcattttaatactccaaattcatataaggtagagagtgaaaatcaaattccaggatataattacacaagtattacacctggttacaactattactttaaacataataatgtccttattgttgttctcgaatctaattatggaaatgaagaaatatatacaactgtaatgaatatggctaatgacgcttatcctgatgttgattggagaattgctttgtttcatcatgatatttttagtgatggttacatccattcagaagaaggtcgtgttcaagaattacgtcaatggttaactccattatttgataaatttaattttgatctagttattaatggtcatgatcatatgtattctgccagtcattttattacttatggaaataataataatatttataaatttgaaaaaattgaaaaaaataaaatttataaagatcccaatggtacaatgtttattactgcaaattgctcaactggcagtaagctttacgatgttggggatccaaaagattttatttatttctctaatcaaacgtttac

SEQ ID NO: 25823 - DNA, 813 bp, Neocallimastix californiae
  Metallo-dependent phosphatases
taaatttgttttcgttggagatccgcaaattggtggttctaatgatcgtcttgcttatcaatcaaattctagaatgaatagtgattctattagaaatgatgcctttaattggaatatgacggtcaatagtttctatgaattaactggaaaaccaagtcttttattatctgctggtgatcaagctgatcaaatgggtaatgataaaactcaagaaagacaatattctgcctatcttcttccagaattaatcaagaaaattccaattgcacctgctcttggtaatcatgaagtttattctgaaagtttcagacgtcatttcaatgttccaaatcctatacttaaaaaaagattttattctaataagcctgtttcagcttataattattactttaaatataataatgttcttgttgttgttattgaaacaaattacaatacctgtcatgaatgtgaaaaagtaatttcagaggctgttaaacaatatccatctgctgattggcgtgttgctttattccatcacgatctttatggtaatggtaaaactcactctcaaggagatgctcaaaaattacgtccatgtttaacaggtctttttgatatttatcactttgatcttgttattaatggtcatgatcatgtttatacctcaacccattttgttaaattccaagattccaaaaaaaagacttacgatattgctaaaattagtaaaggttctgtaaacgaaaatccaaatggtactttctatgtcactgcaaattgttccacaggaagtaaattccttcccttttatgaaggaaaacttgattacgt

SEQ ID NO: 25824 - DNA, 666 bp, Neocallimastix californiae
  Metallo-dependent phosphatases
caaatttattttccttggtgatccacaaattggtggttcaataggtagacatcaatatcattcgtcggattattttgattatgctgaagccattagaaatgatgctttcaattggaatataacgatttttaattccattaaatttactaaaactcctagtcttatattatctgctggagatcaagccgataccatgggtgatgatatcactcaagaacagcaatattcaggtcttcttcttccagaattgataaagactattccatttgctcctacacttggtaaccatgaagtattttctgaaagttttagacgtcattttaatgttccacatccatatatcccaaagaaatatgatgatttagattatgttcctgcatataactactactttaaatataataatgttttagttgttgttctagaaagtaatcataattcctgtcacgattgtgaaatagttatggctaaagctgttgataaatatccaaatacagattggagaatcgctttattccatcatgatatttatggtaatggtgctactcattcccaaggtgacgcaaagaaattaagaccatgtttaactggtctttttgatatttataaatttgatcttgtaattaatggtcatgaccatgtttatactacaacaaaattcattaa

SEQ ID NO: 25825 - DNA, 915 bp, Neocallimastix californiae
  Metallo-dependent phosphatases
cagatttgtttttcttggtgatccacaaatcggtgcatctcgtaatcttatttctggtaaaaagtcccttacagatgatgaaggtcttagaaatgatgcgttcaattggaacatgactatatataactcttatgaatttgctaatgaacctagtcttattttatctgctggagataatgctgattctggtcagtcaccaggtgatgataaaaaatctgaagaaaatattaaaattgatctcctaagacaggaaagagaatattccactttattacttccacagataatgcaaaaagttccatttgcttctgctattggtaatcatgaatcttttactcctacttttaggtatcattttaatactccacattcctataaagttgaaagtgataatttcatcaaaggatttcaatccagtataactcctggctataattatttctttaaatataataacgtacttatcgttgtattagaatccaattacagtacggaggaacagtatagagaagttattgaaaatgctattactacctatccagaaacagattggagaattggcttattccatcatgatatttatagtaatggttatggtcattccactgaaccacgtgtcatggatttaagaaaatggttaacaccaatgcttgataagtatgattttgatcttgttattaatggtcatgatcatgtctatgttgctacccattttgttacctcggataaaaatagtaaaaatggctatagttttaataaaattgaaagaaacaaagtttataatgatccaaagggaaccctctatcttaccgccaattgttctacgggaaataaactttatcgtcttatagatccatttgattttgtttactactccaatcaaacttatacctcaacatttggtgttttagattt

SEQ ID NO: 25826 - DNA, 831 bp, Neocallimastix californiae
  Metallo-dependent phosphatases
taattttatttttttaggggatcctcaaattggtggttctaacagtcgtcattccgccttggatcctactcgaccacttacagtggaggaaggtactagaaatgatgcttttaattggaacagaacaattacaaattcattccaatttactcgtgaacccagtgttattatgacagcaggtgatcaagcagattcaatgtgtattgattctaaccttgatgaaatttataatcaagaaactcaatactctgctttccttcttccagaattaatgcaaaagattccaaccgcaaccactgttggtaatcatgactccttcacaacaaattatagaaatcattttaatccaccaaacacttacactaccccggaatatgttatggctaatggattttcaggagtaataccaggatatagttatttctttaaatataataatgtccttgtggtcgtgctagaaaccaattataataattgtaatgattttgaaaacgttattaataaggccattgagaaatatccatataccgattggcgtattgccatgtttcatcatgatatatatggtgatggttatattcattcgacggaggattatattactaaatatttacgtccatgtttaactggtattttcaccgataaaaaatttgatcttgttattaatggtcatgatcatgtctatacggcttcacatttcatttcgtatactggtgcttataataatggtggttatagtttcagtcatatagaaaagaataaagtttatcgagatccaaagggaaccctctatattacagctaattgttcttctggtagtaaactgtatac

SEQ ID NO: 25827 - DNA, 138 bp, Neocallimastix californiae
  Metallo-dependent phosphatases
tacaatgtatattacagctaattcttcaacgggtagtaagctctataaaactaaggattatgatatgggttatctttacttctacaatcaaacttattcttctacttttggtattttagattttaaaaatgaaaatgg

SEQ ID NO: 25828 - DNA, 729 bp, Neocallimastix californiae
  Metallo-dependent phosphatases
cagatttattttccttggtgatccacagattggagcttctcataatgtcctttccattgataaatatattgatgatgatgaaagtcttaggaacgatgccttcaattggaatatgacgatatacaattcttattcaaaagcaaatgaagcaagtcttattttatctgcaggagataatactgactctggtcaatctccaagtgatagagatattttgagatatccagacgaattggaatatgatctcataaaacaagaaaaagagtattcatccttactgcttccagaattaatgcaaaaagttccatttgcttcagctgttggtaatcatgaatcgtttactgcttcttttagataccattttaatactccaaattcgttagaggttgaaagtaataatcaaattccaggatatgattatgctagcgttaccccaggctatagctacttctttaaatataataatgtacttattatcgttctcgaatctaattatggtactgaagaacaatatgaaacattattggaaaaggcatgctcaacctatccaggtgttgattggagaatcgcattatttcatcatgatatttatagtaatggatttaatcactcagaggaagaaagagttttattacttcgtcaatggcttacaaaattactttataaaaataaaattgatcttgttattaatggtcatgatcatatttattctgcaagtcattttatttc

SEQ ID NO: 25829 - DNA, 831 bp, Neocallimastix californiae
  Metallo-dependent phosphatases
taactttatatttgtaggtgatccacaaattggtggttcacatggtaaacctaatttcttagatatgtccaaagaacttactaacgatgaagctacaagaaatgatgcttttaattgggaacgtacaatgaataaagctttcgaattaaaaagtaataatcctccaagtcttttattatcagctggtgatcaagctgatgatgaaaaacttcaagattatttagatgaaactcaattttcagccttacttcaacctgctgtattaaagggaattccacatgctatgactgttggtaatcacgaacaatataacgaaaatttcagacatcactttaatactccaaattcttttactgaaatagaacgctctgaccgtgaagtcattcctggttttaattacttctttagatttaataatgtattagttgttgttcttgatactaatgaaccttctacttatgactattctcatactatgaaaaatgcagttacaaaatatccagatactacttggcgtattgtaatgtttcatcatgatcttttcggtattggtagaacccattcacaaggaacttatattgttaataaattaagacctattttaaacccattattagcaaagtataaagttgatcttgttattaatggtcacgatcattattattcaacatctcattttgtttcttttgacggtgttaattatgatatttcagaaatttctgaaaataaaacatttaataatcctaaaggtatcctttatattactgctaactgtgctacaggaagtaaacttaatccaagaaatgatgctaaggttgattatatttatca

SEQ ID NO: 25830 - DNA, 825 bp, Neocallimastix californiae
  Metallo-dependent phosphatases
taaatttgcttttgttggtgatccccaaattggaggttctaatgaacgtcttgcctataaatcaaatttactaatgggaggtagtgacggtatgagaaatgatgcctttaattggaatgtaaccgttaatagtttttttaagcaaacagaacttatgccaagtcttttattatctgctggtgatcaagtagattttgtaggggatgacttggatttagaacaacaatactctgcctatcttcttccagaattaatgaaatctcttccagttgctccaactttaggtaatcatgaaaaatatagtaatagttttagacgtcattttaatgttccaaatccatatattccaaataaattaaaggatatgagtaatgataatatctatcccatatcctcttacaattacttctttaaatataataatgttcttgtggttgttcttgaaagcaatcgtaattcttgtttagattgtgaaatggtaatatcaaacgcagttaataagtatccagaggctgattggcgtattgctttattccatcatgatctttatggtaatggaaaaactcattcccaaggtatagaagattctctgcgattaagatcatgtttgactggtctctttgatatttacaaatttgatcttgtcattaatggtcatgatcatgtccacacaactacaaaatttattagttataataataaaaataataatgattataatatttctaacattcagaaaaatgtaaaaaatgaaaatccaaaaggtaccttcttcattaccgctaattgttcaactggtagtaagttccttgactttgaagaaaa

SEQ ID NO: 25831 - DNA, 801 bp, Neocallimastix californiae
  Metallo-dependent phosphatases
taaatttgtattcgttggagatccacaaattggtggttctaatgatcgtcttgcatataaatcaaaatccaaaatgaatgagagttccattggaaatgatgcctttaattggaatatgacggttaatagtttctatgaattaactggtaaaccaagtcttttattatctgctggtgatcaagctgattatatgggcggtgataaaactcaagaaagacaatattctgcctatcttcttccagatttaatcaagaaaattccaattgctcctgctcttggtaatcatgaagtttattctgaaagtttcagacgtcatttcaatgttccaaatcctatgtttaatgcgttacattataaaaccagttactcagcttataattattactttaaatataataatgttcttgttgttgttattgaatcaaattacaatacatgtcatcaatgtgaaaaaataatttcaaaagctgttaaggaatacccagatgctgattggagaattgctttatttcaccatgatctttatggtaatggtaatacacactctcaaggagatgcccaaagattacgtccatgtctaacaggtctttttgatattcataaatttgatcttgttattaatggtcatgatcatgtttatacctcaacccatttcgttaaattccatgattcccaaaacaagatttacgatattgctaaaattagtaaaggttctgtaaatgaaaatcctaatggtactttctatgtcactgcaaattgttccacaggaagtaaattccttcctttttatgaaggagaact

SEQ ID NO: 25832 - DNA, 612 bp, Neocallimastix californiae
  Metallo-dependent phosphatases
ttcagcttttcttcttccagaattattaaaaactattccatcggctacagccgtgggtaatcatgattcttttactgaaaatttcagacatcattttaatacacccaattcctatctcaatcctgaatataccgatattattccaggatataattatttctttaaatttaataatgttcttgttgttgttttagaaactaactatggtacttgtgatgattttacaaatgttatatctaaagccattaagaaatatccatcgacagattggagaattgctatgtttcatcatgatatttatggaaatggtgaatatcattcccaggatcctcaaattacagaagttttgcgtccatgcttaactaaattattatatagaaatgagtttgatcttgctattagtggtcatgaccatgtctattcagcctcacattttgtaacctatgataaagaaagtgaaaaaggatatgctgtaaatgaaattaaaaaaggaaatgtatataaaaatccaaagggaacattttatcttacagcaaattgttctaccggtagtaaactctacacttttattgataaaaaaccaagttatatttatcattacaaacaaacttt

SEQ ID NO: 25833 - DNA, 117 bp, Anaeromyces robustus
  Metallo-dependent phosphatases
tactttctttattactgcaaattgttctactggtagtaagctttatggttacaatgatgaaatcgatgattatcttagttactttaatcaaacttatacctcttcctttggtactat

SEQ ID NO: 25834 - DNA, 690 bp, Anaeromyces robustus
  Metallo-dependent phosphatases
cacagtagccttccttggtgatccacaaattggtggttctgcaggacatattccatatgaaaagaactttaaagatacattaagtatagaagaagcaacaagaaatgatgcttttaattggaatatgacaatttataaaatattcgaaaaaactgttaaaccaagtttaatattatcagctggggatcaaattgattatgatggaaatagaaaatcagaatatgatattgatattcaagaagaacaatatgctgctttctttttaccagaaaaattaaaacaagttccaattgctgaagctattggtaatcatgaatcaagattagatacctttaatttacattataatgtaccaaatccatatgatactccaattgaaccacaaattgcaccaggatatagttatttctttaaacataataatattcttgtagttgtattagaaactaatttcggtttttgtgaagattatcaagaagttatgagaagagcctataataaatatccagatacggattggcgtattgctttattccatcatgatatttatagtagtggttggtgtcattctcaagaagaatctgtcactgatttcttaagaccatgtttaactgaactttttactaaatataaatttgaccttgccattaatggacatgatcatatttattccacctctcattttgttac

SEQ ID NO: 25835 - DNA, 906 bp, Anaeromyces robustus
  Metallo-dependent phosphatases
taactttatttttgttggtgatccacaaattggtggttcatataatcgtatttcagttgctgatcttactagaacactaactagagaagaaggtactagaaatgatgcatttaattggaatatgactgttaatagttcttttgaagtaactaaaacaccaagtgtattcttatctgctggtgatcaaatagatactgaatgttttacagttgatgattattcatattatttacaagaaactcaatattctgctttccttcttcctgaattattaaaatctattccatcagctactactgttggtaatcatgaatctttaaccaaaaatttcaaacatcattttaatactccaaattcttatcttacaccacttgaaaaagaccttgctccaggttataattatttctttaagtataataatgtacttgttgtagttcttgaaactaattatggtttttgtgatgatttcaaggaagtcatgagacaagcttacttaaaatatcctgatactgattggcgtattgctatgttccatcatgatatttatggtaatggtaaatatcattctcaagatgattatattacaatgaaattgcgtccatgtttaactgaattaatatctaaatataagtttgatcttgttataaatggtcatgatcatgtttattcagcatcttactttatctcctatgaggatagtgcaaaaggttatgatccaaaggaaattgtcaaagaaaaagtcaatgaaaatccaaatggaaccttttatattactggtaattgttcttctggtagtaaactttatggttatgttgaaaaagattttgattatgtttataattataatcaaacttatacttcttcttttggtactttggactttgaaaaagaagaagataaagttag

SEQ ID NO: 25836 - DNA, 918 bp, Anaeromyces robustus
  Metallo-dependent phosphatases
tgcatattttggtgatccacaaatcggtggttctaaaggtcgtctttctatagccaatccaacagaacctttaaatgtattcgaagcaacaagaaatgatgcatttaactggaataatacagtttataaagcttatgaattccaaggttttcaacaaccagatttttattttacagcaggtgataatgcagatgaacaagcctttcctgatgtctatgaaagtcaagaaagccaatattctgcatttctcttaccaaaaataatgcaacaaattcgtttagttcctgctttaggtaatcatgaaatcaatagtaaaaattttaagaatcattttaatgtaccaaatccatatgccgatgaagaagtaagaggacaaaattatcttccatcttatcattattactttaaacattataatattcttgttattgttcttgaaagtactacaggttttgattatgaatttgaagaaattatgtctcgtgccactaaatcatgtccagattgtgattggcgtatagttatgttccatcatgatatatatggtgctggtgaaacacatattaatgaagatcgtgtacaatatttacgaccagtattacttgaattattatctaaatataatattgatgtcgttatcaatggtcatgatcatgtttattctcaatcttatttccttaaatatgataaaaatagtagtactaagtatactaaacttgaaataccaaaagataaaacttattataatccagaaggtactttattcatcacagctaattgtgctactggaagtaaattatacagaactgcggaaaatgttgattacataaatactgcttcacaaactttcagtataaattctggatatttaatatttgatagaaatgaaaaaagagtatctttaacccttttctctta

SEQ ID NO: 25837 - DNA, 684 bp, Anaeromyces robustus
  Metallo-dependent phosphatases
agtcataataggtggtgatccacaaattggtgctaatactaaaagagttgcatatataccagaaaaaggttggactcttcaaactggattagatgctgcaacaaatgatgcctttaattggcgtttaactttgaagaatgcttattctaaacatccagatacaagttttattattactgctggtgaccaaattcataattcagataataatcaacaagaaattgaatatgcaggtttcctttctaatccatatcttcgtgttttaccacttgcttcaactgttggtaatcatgatcatgccggtaattctattaatttcaagcatcatttcaataatcctataaaagtaacaaaggaagctggtgctgtaagttctggtccagattatttttattctcgtggtaaatcactttttattcatctcaatggtaataatttaaatattaaggatcataaaaatactattgatgaagctattggtgcctaccctaataatatttggagaattgttgttattcattttgatttatacggtcctgcttctcatcttaatgatgatactgttaaagttttacgtacaggattgactcctgttttctttgaaaccaaaattgatgttgttcttcaaggtcataatcatattcatgccagaactcatcttataactagagttgaagtatgccc

SEQ ID NO: 25838 - DNA, 1002 bp, Anaeromyces robustus
  Metallo-dependent phosphatases
taattttatttttgttggtgatccacaaattggtggttcacatggtcatatttcaactgttaaaaaaaatggtatagttactattgcagaagctattccaaatgatgcttttaattggaatgtaactatacaaagttcatttagttttgcaaaacaaccaagtttatttatttctgctggtgatcaagctgatactgatttaaaacgtgttcgtgaaaacgaaactaataaatataacagtaattgtattgaatataatgaacatcgtatattccaagaacaagaatattctgcattcctttatccaaatttattaaaaactattccagtagttgctgctgtaggtaatcatgatgcttatactactagttttagagaccattttaatactccaaattcatatcttacaccagaaaagccaatttcagttattacaccagataatggtaaaactagtagtataattccaggttataattatttcttcaagtataacaatgttcttgtcgttgttcttgaaactaattttggtactgaaaacgattttaaaactgttattgaaaatgccataaataaatatccaaatacagattggcgtattgctgtattccatcatgatatttatggtagtggatatactcattctcaagattggactatcgcagatccagattatggtatacgatcagtattaacaaaattattaaatgaaaataattttgatcttgctattaatggtcatgatcatgtttatacagcttcaaaatttatttcttatgatgaaaatagtaaaaagaaatatcatatggaagaaattgaaagtggtaaagtttataaagaaagaaaaggtactttatttattactgctaattgttctactggtagtaaactttatgatattgttcatccagatccagaatacgctcatgtatcaaaacaagattataaggttacttttggtattttaaatttctctaaaaagaatggaaccactacattaga

SEQ ID NO: 25839 - DNA, 663 bp, Anaeromyces robustus
  Metallo-dependent phosphatases
taaatttatttttgttggtgatccacaaattggtggttctcatagtcatgtagctcatggtatgagaagagttcttggtcttgatgatggtattagaaatgatgcctttaattggaaaagaactatttctaaagcctttgatcttactaaagaaccaagtcttgtattatctgctggtgatcaagctgattcaccctatgatttattatatagagaaattgaatattctgctcttttccttccagatcaattaaaaactgttccaatggctgctgctgttggtaatcatgatgctgaaagttttagtcatgatcttcattttaatgttccacatccatatcttactccagaatttcaaagtaaaattccaggatataattatttctttaaatttaataatgttcttgttgtagttctcgaaacaaactttattaccgaaaatgatgcagaagtagttatcaataatgctgttgaaacttatccagaaacagaatggcgtattgctttattccatcatgatatgtttggtaatggatatgctcattctcaatttgatgataccactcgtttacgtaaattcttaactgaattatttactaataataattttgatgttgtcattaatggtcatgatcatctttatacagcttctaaatttattac

SEQ ID NO: 25840 - DNA, 123 bp, Anaeromyces robustus
  Metallo-dependent phosphatases
tactctttatattactgctaattgttcttctggtagtaaactttataccgaaacaggagataatgataaattagattatgtaaattatttcactcaaacttatacggctacttttggtgtatt

SEQ ID NO: 25841 - DNA, 744 bp, Anaeromyces robustus
  Metallo-dependent phosphatases
caaatttatttttgttggtgatccacaaattggtggtagtaataatcatcgtacttttaatgaaaatagttctcatttacttactgtaccagaaggtactagaaatgatgcatttaattggaatatgactatttataattcttttaaattaactcgtgaaccaagtcttttaatgtctgctggtgatcaagctgatagtgaatgttttaatcaaactttggaaaatttatataatcaagaaactcaattttcagcattattacttccagaaatattacaaactatcccatctgcatttactgttggtaaccacgaatcacatacagaaagttttaagtttcattttaatacaccaaatacttatcgtacaacagaatgtgaaagtgattctggattggaaatatgtaataatggtatttatgattatgatggtcctttcttcagtccaggttatagttatttctttaagtttaataatgtattagttgttgtacttgaaactaattttaatacatgtaatgatttaacaactgttatttcaaatgctgttgaaaaatataaagatatagattggcgtatagctatgtttcatcacgatatatatggtaatggtcaatatcattcccaagaaccatatattacagatgtattacgtccctgtttaactgaattatttgataaaaataaatttgatcttgttattaatggtcatgatcatgtatatactacatcacattttgttgc

SEQ ID NO: 25842 - DNA, 138 bp, Anaeromyces robustus
  Metallo-dependent phosphatases
cacattatatattactgctaattgttctactggtagtaaactttataattatataccagaaacaccggattatgtttattattataatcaaacttatacatctacttttggagttttagattttaaaaaagaaggtaa

SEQ ID NO: 25843 - DNA, 885 bp, Anaeromyces robustus
  Metallo-dependent phosphatases
taaatttatattctttggtgatccacaaattggtggttctcatagtcatgtttcacttggtcaaagaagaattcttggtgttgacgatggtattagaaatgatgcttttagttggaatagaacgatttctaaatcttttgaatttactaaagaaccaagtcttatattatctgcaggggatcaagctgatgatgatgtagatgaattatatcaagaaatagaatattctgctttatttcttccagaattattaaaaactgttccattagctactgctgttggtaatcacgattcttatactattaattataggcaacatttccatgttccaaatccatatcttacaccagaatatcaatatactattcctggatatagttatttctttaaatataataatgttcttgttgtagtacttgaaactaattatattacagaaaatgatgcctatgaaataattccaaatgccgttaaaaaatatccagatactgattggcgtattgctttattccatcaagatctttatagtaatggatatacccattctcaacaatatgatgttcttcgtttacgtccatttttaactaaattattttctgaatataattttgatcttgtcattaatggtcatgatcatatttattcagcatcccaatttgtatcctatgataatattaatgattattataaagtttcttttattcaaagaggaaaacctcaagaaaatcctgaaggtactttatatattacagctaattgttctaccggtagtaaactttatggttttgaagatttcccattagattatatttattattttaatcaaactttttcatctacttttggtgttttagattttcaaaaagaaaatggaaaacatagatt

SEQ ID NO: 25844 - DNA, 912 bp, Anaeromyces robustus
  Metallo-dependent phosphatases
cacttttgtatttgttggtgatccacaaattggtggatctcatggacgtatttctgttgctgatattacaaaagctcttagtgttgaacaaggtactagaaatgatgtctttaactggaatatgacagttagtagctttttcaatttagttgatgaaccaagtttacttttatcagctggtgatcaagtagatgtacaatgttctacaaaaaatattgtttatgatgattataaccaagaaactcaatattctggttttcttcttccagaattattaaaaactattccaatggctgctgctcttggtaatcatgatgctacaagtaaaaattataggtatcatttcaaccttccaaatccttatcttactccagaaacaattggttatgaaattactggttataatttcttctttaaatataataatgtacttgttgtagttttagaatctaataattcatcatgtaatgatttcaaaacttctctaaaaaatgctatcaaaaaatatccaaatactgattggcgtattgctttattccatcatgatatttttggtaatggtgcaactcattctcaaggtggttcattagaattacgtccatgtttatcaaaattactttcaagttataaatttgatcttgttattaatggacatgatcatctttacactgcttcacattttatttcatataatgaaaaagctgaaaataaatatacagtttcaaaaattgaaaagggaaatgttaatgaaaatcctaaaggtacattatatattacagctaattgttctactggtagtaaactttatatcaatgatttattcccatatgattatgttaatgaatttgatcaaccatttaaatcaacttttggtcttttaaaatttgaaaaatctgaagaaaaagtaagatt

SEQ ID NO: 25845 - DNA, 123 bp, Anaeromyces robustus
  Metallo-dependent phosphatases
taccctttacattagtagtaatagttcaacgggtagtaaactttatggttatgatgaaagagattttgattacatttcatattatcatcaaacttatacttcaacatttggtgttttagattt

SEQ ID NO: 25846 - DNA, 690 bp, Anaeromyces robustus
  Metallo-dependent phosphatases
taaatttatttttgtaggagatcctcaaattggtgcttctcatgatcgtatttcatttgctaaaaatttacaagatgttttaaccatacctgaaagtaccagaaatgatgcttttaattggaatatgacaatttataaatcttttgaattcattaaagaaccaagtttattattatctgctggtgatcaaatagatatagcatgttcacctaaaacagaagaagatctttatttacaagaaactcaatattctggttttcttcttccagatttattaaaaactattccatctgttattgctgtaggtaatcatgaagcattaactcattcttttaaacatcattttaatccaccaaatccttatacaacccctattgaaccagaattagcaccaggttatagttatttttttaaatataataatattctttttgttatattagaaacaaattatggattttgtgatgattttaaagaagttatgagaagagcttatttaaaatatccaaatacagattggcgtattgctatgtttcatcatgatatttatagtaatggtagtaatcattctcaagaagaatatattgttagattcttaagaccatgtttaacggaattattatctaaatataaatttgatcttgtaattaatggtcatgatcatgcttattcttcttcccatttaatttc

SEQ ID NO: 25847 - DNA, 924 bp, Anaeromyces robustus
  Metallo-dependent phosphatases
taaatttatttttgttggtgatccacaaattggtggttctgaaggacatgtaacctatgataatccaacagaacctctttctgaagtggatggtactaaaaatgatgcctttaattggaatatgaccattcataaatccttagaattaactaaagaacctagtcttttattatctgcaggtgatcaagttaatgccttttgtatggaaggatatgataaacaatatgaacttcaagaatatgaatattctgcattacttcttcctgatcccttaaaatctcttccaatggcaaccacggttggtaatcatgaaatttatactaaagcttttaaaaatcattatcatacaccaaattcttatgaaactccacttgaaccagatcttgccccaggttataattatttctttaaatataataatgttttagttattgtattggaaaccaattatgggtattgtgatgattttaaagaagttatgagaagagctcatttaaaatatcccaataccgattggcgtattgttatgttccatcatgatatttatagtaatggtaaattccattcccaagaatcctatattacagatactttaagaccatgtttatcccaattaatgacctattataaaatagatcttgtcattaatggtcatgatcatatttattctgcctcacgtttaattacatatgataaaaatgaagatttaggttttaaatcggttcaacttacaccaggtaaaaccaataaaaatgtcaaaggtacttattatgtgaccgctaattgttccacgggtagtaaacttttttcctttattgaagaatctaaagattatacgaataatttcaatcaaacctatacttccacctttggtgtcattgattttgaaaaggataaaaagagtcataccgttcaaatgacggt

SEQ ID NO: 25848 - DNA, 903 bp, Anaeromyces robustus
  Metallo-dependent phosphatases
ccaatttatatttgttggtgatccacaaattggtggttctcatgatcgtttatctgttgctgatccttaccatgtattaacacgtgaagaaggtactagaaatgatgcttttaattggaatatgacaatttataaatcctttgaaaaaacaggaaagccaagtgtattattatctgctggggatcaagtggatacggaatgtttttctggtaccactgaagaagattatagtcaagaaattcaatattcggctttccttcttccagatttattaaaaactattccatccgctacaaccgttggtaatcatgaagctttaaataaaaattatagaaatcattataatactccaaattcacatattccattagaacctgaaattgcacctggttatagttatttctttaaatataataatgttttagtggttgttttagaaacgaattatagtttttgtgatgattttaaagccgttttcaaaaaagcttttttaaaatatccaaataccgattggcgtgtggctatgttccatcatgatatttatggtaatggtagtttccattcccaagatgaatatattattaataaattacgtccatgtttaacggaattactttcttactacaaatttgatttagttattaatggtcatgatcatattttctctgcctcaaaatttgtttcttataaaaagggtaataaatatagtttaagtaatatacaaaagggaaaggtgaataaaaatgccaaaggtactttttatattactgctaattgttcaaccggtagtaaactttttggattcattaatcaagattttgattataattataattttagtcaaacgtatacttctgcttttggggtattagattttcaaaaaagtaatggtaaagttaaatt

SEQ ID NO: 25849 - DNA, 663 bp, Anaeromyces robustus
  Metallo-dependent phosphatases
taaatttattttccttggtgatccacaaattggtggttctcatagtcatgtagctcatggtatgagaagagttcttggtcttgatgatgctattagaaatgatgcctttaattggaaaagaactatttctaaagcttttgaatttactaaagaaccaagtcttatattatctgctggtgatcaagcagatacagaacaagatttattatatagagaaattgaatattctgctcttttccttccagatcaattaaaaactgttcctatggctgctgctgttggtaatcatgatgcttggagttttagtcataaacttcattttaatgtaccaaatccatatcttactccagattatagttactttattccaggttatagttatttctttaaatataataatgcccttgtagtcgttcttgaaacaaattatcttactgaaaatgatgctaatgctgtgatcactaatgctgttaaaacttatccaaatacagattggcgtattgctttattccatcatgatatgtatggtaatggagaagtacattctcaaaataatgatgccacttctttacgtccctatttaacaaaattatttacggaatatcaatttgatgttaccattaatggacatgatcatgtttatactgcttcaaaaattgtagc

SEQ ID NO: 25850 - DNA, 159 bp, Anaeromyces robustus
  Metallo-dependent phosphatases
tccaaaaggtactctttatgttaccgctaattgttcttctggtagtaaacttttcaaaaatttgaaaaaaaatattgattatgttaattattctactcaaacttattctgctacttttggtgttttagattttgaaaaggtcaatggaaaacttagatt

SEQ ID NO: 25851 - DNA, 924 bp, Piromyces finnis
  Metallo-dependent phosphatases
taaaatcctttttgttggtgacccacaaattggtggtgctcacgacagaattactgcttcaaataattactctagagttctcacaagagaagaaggtaatagaaatgatgcttttaactggaatgttactgtatataattcatttaattttgctggtcaaccaagtcttttattatctgcaggtgatcaagccgatgaagaatatgccgtaaaaggtaatgaatacgattataatgaagaatcccaatattctgcttttcttcttccaaaattaatgcaaaccattccaactgtacctacaatcggtaatcatgatagttacacagaaaactttaaatatcatttcaacacaccaaataattatgcttctaaaaattatacaaagtattataatggaaatgaaccaggatacaattatttctttaaatataataacattttatttgttgttcttaacaccaacgctccaatttgtgaagagtttaccgaaattattaataaggctatcactaaatatcccgatacagactggcgtattgccatgttccaccaagatctttatggtgatggtagtactcattctcaaaatgatggtatcacaaaagtattacgtccttgccttacaaaattaatttatgataacaaattcgatcttgttcttaacggtcatgatcacgtttataccgtaagtaaatttattacctacacaggagctgataattatggtggttatggttttaattctattgaaagaaataaggtttaccataagccagatggaacactttatattacagccaattgttctactggtaacaaactttacaagtatgttaagccacaacttgactatgtttattaccatgatcaaacttatactccgacttttggtgttatggatttcaagaaaagtgatggaaaggt

SEQ ID NO: 25852 - DNA, 465 bp, Piromyces finnis
  Metallo-dependent phosphatases
taataatgttcttgttgtagtacttgaaaccaactacggttattgtgatgactttaaagaagttttaagacaagctcatgcaaagtatccaaatacagattggagaattgctatgttccatcataatatctatggcaatggtaaataccattctcaggattatcacattacagatgtattacgtccatgtttaacagaacttctttctaattataaatttgatcttgttattaatggtcatgatcatatttatacagcatcttactttatttcatacagtaacaatgataaaggttacactccagaaaaaattagtcaaaatagaatttatgaaaatccaaagggtactttttacattactgctaattgctctacaggtagtaaactctatgaaagtattgataggacgatggattatgtttataattatggtcaaaattatttatcatcctttggtgtcctaga

SEQ ID NO: 25853 - DNA, 120 bp, Piromyces finnis
  Metallo-dependent phosphatases
tacattgtatatcacttctaattgttccactggtagtaaactttatggattctcctctaatcctaatagagattatgtttataggtataatcaaacgtatagttccacttttggtgtatt

SEQ ID NO: 25854 - DNA, 159 bp, Piromyces finnis
  Metallo-dependent phosphatases
gttccatcatgatatttatggcaatggtagtacacattcatcagataccgatattacctcaaagttacgtccatgtcttacccgtttaatggatcattatcattttgatttggtacttaatggtcatgatcatgtttacaccgtttctaattttattca

SEQ ID NO: 25855 - DNA, 582 bp, Piromyces finnis
  Metallo-dependent phosphatases
atttaaatttatttttgttggtgatcctcaaattggtggttccaaaaatcgttttgcttttcgacctggcggtaaaagtaaaaaatttgttatggaggaagctattcgaaatgatgccttcaactggaacatgaccattgtaaattcatttaagattgccggaaatgaaccaagtttattattatctgctggggatcaagcagaaactatggcagatgattggtctgaagccaattatcttgaacaagaaacccaatattctgctttccttcttccagaattattgaaacaatttccttcagcaaccgccattggtaatcatgattctcttactgtaaactatagaaatcatttcaatacccctaattcctttaccaacccatcctataaggacagttggaagggtagtcgatgggaaggatttattcctggttatagttattatttcaaatataataatgtcgttgtggttgttctcgaaaccaactattctgattgtaccgattttgaaaccgtcattaaggaagccctcaccaagtatccagaggccaattggcgtattgccatgttccatcatgatat

SEQ ID NO: 25856 - DNA, 579 bp, Piromyces finnis
  Metallo-dependent phosphatases
taaatttatttttgttggtgatcctcaaattggtggttccaaaaatcgttttgcttttcgacctggcggtaaaagtaaaaaatttgttatggaggaagctattcgaaatgatgccttcaactggaacatgaccattgtaaattcatttaagattgccggaaatgaaccaagtttattattatctgctggggatcaagcagaaactatggcagatgattggtctgaagccaattatcttgaacaagaaacccaatattctgctttccttcttccagaattattgaaacaatttccttcagcaaccgccattggtaatcatgattctcttactgtaaactatagaaatcatttcaatacccctaattcctttaccaacccatcctataaggacagttggaagggtagtcgatgggaaggatttattcctggttatagttattatttcaaatataataatgtcgttgtggttgttctcgaaaccaactattctgattgtaccgattttgaaaccgtcattaaggaagccctcaccaagtatccagaggccaattggcgtattgccatgttccatcatgatat

SEQ ID NO: 25857 - DNA, 81 bp, Piromyces finnis
  Metallo-dependent phosphatases
taccttttttattactgctaattgttcctctggtagtaaactttacagttttgttgaagataccccagattttgttcacga

SEQ ID NO: 25858 - DNA, 702 bp, Piromyces finnis
  Metallo-dependent phosphatases
taaatttatttttgttggtgatccacaaattggtggttcacatgaccgttactccatttctaatttatatgagagagtattaacggtggatgagggtacagccaatgatgcctttaattggaatagaactattacccattcctttgattttgttaaagaaccaagtcttttattatctgctggtgatcaagctgatgaagaaaacaatagtttctatagtgatcaagaacattataatgaagaaacacaatactctgcattacttctccctaaacaaattcaaaccattccaatggctgctgctatcggtaatcatgacagaaatactgaaaatttcagacatcattttaacgtacctaatccatataaaaatccatcctatcttatggatgatggatggattgaaggttacaactattactttaaatacaataatgttttaattgtagttcttaacaccaatcatgaagaatgtgttgattttgaatccgtcattaccaatgccgttgaaaaatatccagacactttatggcgtattgctttattccatcatgatatttatggtaatggtgttactcattccttagaagatggtatgaagaatgttttacgtccatgtttaaccaaattattatccaattttaaatttgatcttgccattagtggacatgatcacgtctataccgcaagtaaatttattac

SEQ ID NO: 25859 - DNA, 861 bp, Piromyces finnis
  Metallo-dependent phosphatases
taaatttgtatttgttggtgatcctcaaattggaggttctcacgatcgtttttccatcaccaataattatgaaagggttctcacgttgaatgaaggtaatagaaatgacgcattcaattggaatagaactatttctagatcttttgaatttgcaaataaaccaagtctcctacttagtgctggggatcaagccgatgaagaatgtaaacacttggaagataatgaaaaaggacccatggaacttttgaatgaagaaatgcaatattcagcttttcttcttccagatttattaaaatctgtacctgtcgctgctgcagttggtaatcatgatgctagtaataataattttagaaaacattttaattcaccaaattcctacaccgaccccaaataccaagatttaattccgggatataattatttctttagacatcataatgttcttgtcgttgttctcgaaacgaactacgggtattgtgaagatttttccaatgtaattgaaaaggccataaaaaaatatccagacgttgattggcgtattgcaatgtttcatcatgatatctacggtaatggtgtaacccattcgaaggaaccttacattgtcaatgaattacgtccatgtttaacccaattattttatgaaaataaatttgatcttgtgattaacggacatgatcatgtctataccgcttcaaagttcatttcctatgataacaataactacagtgtaagtgatataaaaaagaataaagtttataagcaacccaaaggtactttttacattaccgctaattgttcaaccggtagtaaactttatgattattataaagaagatttggattatgtttatcaaaatagtca

SEQ ID NO: 25860 - DNA, 861 bp, Piromyces finnis; identical to SEQ ID NO: 25859
  Metallo-dependent phosphatases

SEQ ID NO: 25861 - DNA, 852 bp, Piromyces finnis
  Metallo-dependent phosphatases
taatttcattttccttggtgatcctcaaattggcggttctaagaatcgttacagtaaacttcttaaggatagaggggtcaccatcgaagaaggtattagaaatgatgcatttaactggaatagaaccctgaccgaagccgtaaactatgtcaaaactccaagtcttatcttatcagcaggggatcaagcagaatctatggcttacgattctgatgaagaacttattttacaagaaaaagaatatgctgcttttcttactccaaatttaattcaatccattcctactgccgctaccgttggtaatcatgatcaatatacggataattttattcatcattttaatccaccaaatttatacaatcaagatactgttcttcaaaccaccggtacgcgtgtccttcccggttacaactattactttaaatataataatgtacttgttgtggtacttgacaccaacaatcacaattgtaccgatttttctacggttatcgaagaagccattgaaaaacatccaaagacggattggcgaattgccatgttccatcatgatatttacggtaatggtagtactcattcttccgaagatgatattaaactttacttacgtccatgcctaactccattgattgataaggctcattttgatcttgtcattaatggtcatgatcatgtctactcctcttctaaatttatttcctacaatgatgatggaagtctctattcgttgaacgacattgaaaccaataaaatttatgaaaatcaaaatggtaccctttaccttacggcaaattgttctaccggtagtaaactttacggattttcttccattaaaaactacacctcctacta

SEQ ID NO: 25862 - DNA, 852 bp, Piromyces finnis; identical to SEQ ID NO: 25861
  Metallo-dependent phosphatases

SEQ ID NO: 25863 - DNA, 852 bp, Piromyces finnis; identical to SEQ ID NO: 25861
  Metallo-dependent phosphatases

SEQ ID NO: 25864 - DNA, 852 bp, Piromyces finnis; identical to SEQ ID NO: 25861
  Metallo-dependent phosphatases

SEQ ID NO: 25865 - DNA, 993 bp, Neocallimastix californiae
  Metallo-depent_PP-like
tccaaataatttcagatttgttttccttggagatccacaaatcggtgcatccaaaaataacttttcagttttaacggagcaacgtcttactgaggaagaaggtcttagaaatgatgctttcaattggaatatgactatatataattcttatgcaaaagcaaatgaagcaagtattattttatctgctggtgataatgctgattctggtcaatctccaggtgattctagcggtaaaactgaagaatatattagaaatgatcttctcagacaagaaagagaatattcaaccttattacttcctaaattaatgcaacaggttccatttgctccagctgttggtaatcatgaatcttttactccttcttttagataccattttaatactccaaatccataccttataggtaaaactgaaacaagtcctggttatagttatttctttaaacataataatgtacttgttatcgttctcgaaactaattatggtaccgaggaagaatttagagaagtagtaggaaaagctaattcaacttttccagatgttgattggagagttgctttattccatcatgatatttatagtaatggttatacacattcacaagatcctttaattaccgaatatatacgtaaagaagtaactcaattgtttgatatatatgatattgatcttgttattaatggtcatgatcatatgtatgctgcaagtcattttattacttatgatgaaagtagaaaagaaggatataaagttgatgaggttgaaaaaaataaagtttacagtagtcataaaggtacaatgtatcttactgctaactgttctactggtagtaaactttatggtattataaatgatagagcctttgattatatttattattctaatcaaacgtttacctctactttcggtattttagattttactaataataatggtaaaacacaaatggtaattacttcatatgaagttgatacttttaatgttattgatgg

SEQ ID NO: 25866 - DNA, 945 bp, Neocallimastix californiae
  Metallo-depent_PP-like
tccagataatttcaaatttgtatttgtcggagatccacaaattggaggttccgtttctagagttggttatcatacttctaaaacttttgattattcagaagctgtaagaaatgacgcttttaattggaacgttactgttaatagtttctttaaaaaaacgggtaatccaagtcttttattatccgctggtgatcaagctgatactatgggtgaagatgaatcacaagaacaacaatattctggtcttcttcttccagaattaattaaaaccataccaattgctccagctcttggtaatcatgaagtatactctgaaagttttagacatcacttcaatgttccaaatccatacaaaccaaagaaattggatactttatcacgtatttcagcctataattattatttcaaatataataatgttcttgtcgttgttcttgaatccaatcataatacttgccatgattgtgaaatggttatttcaaatgctatagatgaatatccggacactgattggcgtattgctttattccatcatgatctttatggtaacggaaaaactcactctcaaggtagtagtgacggtaaaagattacgtgcttgcttaactggactttttgatatttataactttgatcttgttattaatggtcatgatcacgtttacacctctactcactttattacttattctagtaagaataataaaggagaaaattataaattaagtgaaatagaagaaggaaaaacaattaaaaatcctaatggaactttattcattactgctaactgctcttctggaagcaaatttttagattttgaagattcaagttttgattatgtttatcaatttaatcaaacttttacttcaactttcggtgtattagattttaaaaatgaatccggaaaagttagaatgactattaatgtttatgaagttgattctca

SEQ ID NO: 25867 - DNA, 984 bp, Neocallimastix californiae
  Metallo-depent_PP-like
agataattttagatttattttccttggtgacccacaaattggtgcttctgctggtgccatctctgaacttcatcttaataaagttctttctgacgatgaaggtctcagaaatgatgccttcaattggaatatgactatttataattcctatgaaaaagcaaatggacctagtcttatcctttctgctggtgataatgccgattctggtcaatcaccaagtaatgaaaatagtaaaatcgaagatattaaaaaagatcttattagacaagaaaagcaatattctgctcttttacttccaagtttaatgcaaaaagttccatttgccactgctcttggtaatcatgaatcctattctccttccttcaaatatcactttaataatccaaacccttataaggtagaaagatcagaatttagtccaggctataactatttcttcaaatataataatgcccttgttgttatgcttgaatctaactatggtattaaagatgattattcagatgtcatttctaatgccacttctacttatccagatactgattggagaattgctgtattccatcatgatatctacagtaatggtgttatgcattccagtgaatacagagttactgaattacgtaagtggttaaccccattgtttgatgaatatgattttgatcttgttattaacggtcatgatcatatgtattctgccagtcaattcgttcatcatgataagagtagtacagataaatttaagtataaagtttctgaaattgaaagaggtaaggtttacgacaatccaaaaggaacgttatatattactgctaattgttccactggtagtaagctttacaataccaaaggaaataaagattatctttactattataatcaaactttcacttcaacctttggtattttagatttcaagaaagaaaatggtaaatctcaattaagtattacttcttatgaagtcgatactcttgatatcactga

SEQ ID NO: 25868 - DNA, 987 bp, Neocallimastix californiae
  Metallo-depent_PP-like
tccagacaatttcaattttatttttgttggtgatccacaaattggtggttcaaacgatcgtattatctatgattcaagagaaagccaaggttattctttagctattaaaaatgatgcttttaattggaatatgacaatttatagttcttttgaaatgacaaaaaatccaagtcttttattatctgctggtgataatgctgataccgaaaattattatagcagtatagattattacaatcaagaatctgaatattctgcttttcttcttcctgaattaataaaaactattccaatagctccagctcttggtaaccacgaaacaaaaactgaaggttataaataccatttcaatccaccaaatacttactctacaaaaagatttgaacaaatgagtttagtaccagcatacagttatttctttaaatataacaatgttcttgtcgttgttttagaatctaataaaagtagctgtattgattgtgaaataatcttttcaaaagcagtaaaaaagtatccagatactgattggcgtattgctttgttccatcatgatgtttatggtaatggtaaaactcactcccaaggggatgctttaagattacgtccatgcttaactggtcttttcagtatctataaatttgatgttgtaattaatggacatgatcatgtctatacaacaacaaagtttgttgcctttaataatggcaatgaaaagaaaaattatatagttaaagatattaaaaaaggagaagttaataaaaatccaaaaggtacattctttataacagctaattgttcaacaggaagtaaattcttttcttttgataagggaacttttgattatgtttataattataatcaaacttatacttcaacctttggtgtaatggatttcaagaaagccaatggaaaagttagattaacaattgacatttatgaagtagatactaagaaaaaaattgatgaatcatacatatttgaaaaatc

SEQ ID NO: 25869 - DNA, 1041 bp, Neocallimastix californiae
  Metallo-depent_PP-like
agaaaatttcagatttgtttttcttggtgatccacaaattggttcatctcgtggtagttattcaattggtaatcgtaaacaatttagtgatgatgaaggtcttagaaacgatgcttttaattggaatatgactatattcaattcttattcaaaagcaaatgaagctagtcttattttatccgctggtgataatgctgattctggtgaaacgccaagtaatggtgatattttagataatattagtaatattagtaaaatgtccactgatcttctcagacaagaaaaagaatattcatctttattacttccagaattaatgcaaaaagttccatttgttcctgctgttggtaatcatgaatcttatactgctacatatagatatcattttaatactccaaattcatataaggtagagagtgaaaatcaaattccaggatataattacacaagtattacacctggttacaactattactttaaacataataatgtccttattgttgttctcgaatctaattatggaaatgaagaaatatatacaactgtaatgaatatggctaatgacgcttatcctgatgttgattggagaattgctttgtttcatcatgatatttttagtgatggttacatccattcagaagaaggtcgtgttcaagaattacgtcaatggttaactccattatttgataaatttaattttgatctagttattaatggtcatgatcatatgtattctgccagtcattttattacttatggaaataataataatatttataaatttgaaaaaattgaaaaaaataaaatttataaagatcccaatggtacaatgtttattactgcaaattgctcaactggcagtaagctttacgatgttggggatccaaaagattttatttatttctctaatcaaacgtttacttcaacttttggtttattagattttaaaaatgaaaatggaaaacttcaattaagtattacctcttatgaagtagatacctacaaagttactgatggtccttatatttttgaaaaagatgc

SEQ ID NO: 25870 - DNA, 966 bp, Neocallimastix californiae
  Metallo-depent_PP-like
taatgattttaaatttgttttcgttggagatccgcaaattggtggttctaatgatcgtcttgcttatcaatcaaattctagaatgaatagtgattctattagaaatgatgcctttaattggaatatgacggtcaatagtttctatgaattaactggaaaaccaagtcttttattatctgctggtgatcaagctgatcaaatgggtaatgataaaactcaagaaagacaatattctgcctatcttcttccagaattaatcaagaaaattccaattgcacctgctcttggtaatcatgaagtttattctgaaagtttcagacgtcatttcaatgttccaaatcctatacttaaaaaaagattttattctaataagcctgtttcagcttataattattactttaaatataataatgttcttgttgttgttattgaaacaaattacaatacctgtcatgaatgtgaaaaagtaatttcagaggctgttaaacaatatccatctgctgattggcgtgttgctttattccatcacgatctttatggtaatggtaaaactcactctcaaggagatgctcaaaaattacgtccatgtttaacaggtctttttgatatttatcactttgatcttgttattaatggtcatgatcatgtttatacctcaacccattttgttaaattccaagattccaaaaaaaagacttacgatattgctaaaattagtaaaggttctgtaaacgaaaatccaaatggtactttctatgtcactgcaaattgttccacaggaagtaaattccttcccttttatgaaggaaaacttgattacgtttttaattacaaccaaactttcacttcaacttttggtgttttagatttccagaggagcaatggtaaagttaaattaaccattaatgtttatgaagtagaaactcatgatgttgttgatggtccatacatttttgaaaagaatga

SEQ ID NO: 25871 - DNA, 915 bp, Neocallimastix californiae
  Metallo-depent_PP-like
ccctgataatttcaaatttattttccttggtgatccacaaattggtggttcaataggtagacatcaatatcattcgtcggattattttgattatgctgaagccattagaaatgatgctttcaattggaatataacgatttttaattccattaaatttactaaaactcctagtcttatattatctgctggagatcaagccgataccatgggtgatgatatcactcaagaacagcaatattcaggtcttcttcttccagaattgataaagactattccatttgctcctacacttggtaaccatgaagtattttctgaaagttttagacgtcattttaatgttccacatccatatatcccaaagaaatatgatgatttagattatgttcctgcatataactactactttaaatataataatgttttagttgttgttctagaaagtaatcataattcctgtcacgattgtgaaatagttatggctaaagctgttgataaatatccaaatacagattggagaatcgctttattccatcatgatatttatggtaatggtgctactcattcccaaggtgacgcaaagaaattaagaccatgtttaactggtctttttgatatttataaatttgatcttgtaattaatggtcatgaccatgtttatactacaacaaaattcattaattataataatagtaataaaaaaagttacactctttctgaaattaaagaaggagttacaaataaaaatccaaagggtaccttctttattacagctaattgttcttctggtagtaaattccttgattttactgacaaaacacttgattatgtttttaattctactcaaacttttacctcaactttcggtgttttagatttcaaaaaagaatctggaaaagttaaaatgattattaatat

SEQ ID NO: 25872 - DNA, 1017 bp, Neocallimastix californiae
  Metallo-depent_PP-like
tccagataatttcagatttgtttttcttggtgatccacaaatcggtgcatctcgtaatcttatttctggtaaaaagtcccttacagatgatgaaggtcttagaaatgatgcgttcaattggaacatgactatatataactcttatgaatttgctaatgaacctagtcttattttatctgctggagataatgctgattctggtcagtcaccaggtgatgataaaaaatctgaagaaaatattaaaattgatctcctaagacaggaaagagaatattccactttattacttccacagataatgcaaaaagttccatttgcttctgctattggtaatcatgaatcttttactcctacttttaggtatcattttaatactccacattcctataaagttgaaagtgataatttcatcaaaggatttcaatccagtataactcctggctataattatttctttaaatataataacgtacttatcgttgtattagaatccaattacagtacggaggaacagtatagagaagttattgaaaatgctattactacctatccagaaacagattggagaattggcttattccatcatgatatttatagtaatggttatggtcattccactgaaccacgtgtcatggatttaagaaaatggttaacaccaatgcttgataagtatgattttgatcttgttattaatggtcatgatcatgtctatgttgctacccattttgttacctcggataaaaatagtaaaaatggctatagttttaataaaattgaaagaaacaaagtttataatgatccaaagggaaccctctatcttaccgccaattgttctacgggaaataaactttatcgtcttatagatccatttgattttgtttactactccaatcaaacttatacctcaacatttggtgttttagattttaaaaaggaaaatggtaaaactcaaatgaggattacaacctatgaagtggatacttttaatgttactgatggtacttatatctttgaaaa

SEQ ID NO: 25873 - DNA, 948 bp, Neocallimastix californiae
  Metallo-depent_PP-like
agaaaattttaattttatttttttaggggatcctcaaattggtggttctaacagtcgtcattccgccttggatcctactcgaccacttacagtggaggaaggtactagaaatgatgcttttaattggaacagaacaattacaaattcattccaatttactcgtgaacccagtgttattatgacagcaggtgatcaagcagattcaatgtgtattgattctaaccttgatgaaatttataatcaagaaactcaatactctgctttccttcttccagaattaatgcaaaagattccaaccgcaaccactgttggtaatcatgactccttcacaacaaattatagaaatcattttaatccaccaaacacttacactaccccggaatatgttatggctaatggattttcaggagtaataccaggatatagttatttctttaaatataataatgtccttgtggtcgtgctagaaaccaattataataattgtaatgattttgaaaacgttattaataaggccattgagaaatatccatataccgattggcgtattgccatgtttcatcatgatatatatggtgatggttatattcattcgacggaggattatattactaaatatttacgtccatgtttaactggtattttcaccgataaaaaatttgatcttgttattaatggtcatgatcatgtctatacggcttcacatttcatttcgtatactggtgcttataataatggtggttatagtttcagtcatatagaaaagaataaagtttatcgagatccaaagggaaccctctatattacagctaattgttcttctggtagtaaactgtatacatttgttgatgataatctggaaccggattatgttaatttttctaatcaaactttcaccgctacctttggtgtattagattttaaaaaggaaaatggtatttctagatt

SEQ ID NO: 25874 - DNA, 1020 bp, Neocallimastix californiae
  Metallo-depent_PP-like
tccctataatttcagatttattttccttggtgatccacagattggagcttctcataatgtcctttccattgataaatatattgatgatgatgaaagtcttaggaacgatgccttcaattggaatatgacgatatacaattcttattcaaaagcaaatgaagcaagtcttattttatctgcaggagataatactgactctggtcaatctccaagtgatagagatattttgagatatccagacgaattggaatatgatctcataaaacaagaaaaagagtattcatccttactgcttccagaattaatgcaaaaagttccatttgcttcagctgttggtaatcatgaatcgtttactgcttcttttagataccattttaatactccaaattcgttagaggttgaaagtaataatcaaattccaggatatgattatgctagcgttaccccaggctatagctacttctttaaatataataatgtacttattatcgttctcgaatctaattatggtactgaagaacaatatgaaacattattggaaaaggcatgctcaacctatccaggtgttgattggagaatcgcattatttcatcatgatatttatagtaatggatttaatcactcagaggaagaaagagttttattacttcgtcaatggcttacaaaattactttataaaaataaaattgatcttgttattaatggtcatgatcatatttattctgcaagtcattttatttcttatgatataaataattcaaatcaatacaagtataatattacagaaattgaaaggaacaaaatttataaagatcataaaggtacaatgtatattacagctaattcttcaacgggtagtaagctctataaaactaaggattatgatatgggttatctttacttctacaatcaaacttattcttctacttttggtattttagattttaaaaatgaaaatggtaaggttcaaatgaagattacttcttatgaagtagatacctataacattaccgatggccc

SEQ ID NO: 25875 - DNA, 963 bp, Neocallimastix californiae
  Metallo-depent_PP-like
tccagataattttaactttatatttgtaggtgatccacaaattggtggttcacatggtaaacctaatttcttagatatgtccaaagaacttactaacgatgaagctacaagaaatgatgcttttaattgggaacgtacaatgaataaagctttcgaattaaaaagtaataatcctccaagtcttttattatcagctggtgatcaagctgatgatgaaaaacttcaagattatttagatgaaactcaattttcagccttacttcaacctgctgtattaaagggaattccacatgctatgactgttggtaatcacgaacaatataacgaaaatttcagacatcactttaatactccaaattcttttactgaaatagaacgctctgaccgtgaagtcattcctggttttaattacttctttagatttaataatgtattagttgttgttcttgatactaatgaaccttctacttatgactattctcatactatgaaaaatgcagttacaaaatatccagatactacttggcgtattgtaatgtttcatcatgatcttttcggtattggtagaacccattcacaaggaacttatattgttaataaattaagacctattttaaacccattattagcaaagtataaagttgatcttgttattaatggtcacgatcattattattcaacatctcattttgtttcttttgacggtgttaattatgatatttcagaaatttctgaaaataaaacatttaataatcctaaaggtatcctttatattactgctaactgtgctacaggaagtaaacttaatccaagaaatgatgctaaggttgattatatttatcattcaaatcaaacttacactgctacttttggtattattgatttcgaaaaggatattgagaaacaagtaaatagaattactattaattattatgatgttgaatccctcgatgttaccgatgg

SEQ ID NO: 25876 - DNA, 996 bp, Neocallimastix californiae
  Metallo-depent_PP-like
taataattttaaatttgcttttgttggtgatccccaaattggaggttctaatgaacgtcttgcctataaatcaaatttactaatgggaggtagtgacggtatgagaaatgatgcctttaattggaatgtaaccgttaatagtttttttaagcaaacagaacttatgccaagtcttttattatctgctggtgatcaagtagattttgtaggggatgacttggatttagaacaacaatactctgcctatcttcttccagaattaatgaaatctcttccagttgctccaactttaggtaatcatgaaaaatatagtaatagttttagacgtcattttaatgttccaaatccatatattccaaataaattaaaggatatgagtaatgataatatctatcccatatcctcttacaattacttctttaaatataataatgttcttgtggttgttcttgaaagcaatcgtaattcttgtttagattgtgaaatggtaatatcaaacgcagttaataagtatccagaggctgattggcgtattgctttattccatcatgatctttatggtaatggaaaaactcattcccaaggtatagaagattctctgcgattaagatcatgtttgactggtctctttgatatttacaaatttgatcttgtcattaatggtcatgatcatgtccacacaactacaaaatttattagttataataataaaaataataatgattataatatttctaacattcagaaaaatgtaaaaaatgaaaatccaaaaggtaccttcttcattaccgctaattgttcaactggtagtaagttccttgactttgaagaaaaaagtatcaattatgtttttaattatactcaaactttcacatcttcctttggtaccttagaatttgaaaataatgatgataaagttaaattaactatcaatttcctcgaagtcgatactcataatttaattgatggaccttacattttcgaaaaggataaagg

SEQ ID NO: 25877 - DNA, 969 bp, Neocallimastix californiae
  Metallo-depent_PP-like
taatgattttaaatttgtattcgttggagatccacaaattggtggttctaatgatcgtcttgcatataaatcaaaatccaaaatgaatgagagttccattggaaatgatgcctttaattggaatatgacggttaatagtttctatgaattaactggtaaaccaagtcttttattatctgctggtgatcaagctgattatatgggcggtgataaaactcaagaaagacaatattctgcctatcttcttccagatttaatcaagaaaattccaattgctcctgctcttggtaatcatgaagtttattctgaaagtttcagacgtcatttcaatgttccaaatcctatgtttaatgcgttacattataaaaccagttactcagcttataattattactttaaatataataatgttcttgttgttgttattgaatcaaattacaatacatgtcatcaatgtgaaaaaataatttcaaaagctgttaaggaatacccagatgctgattggagaattgctttatttcaccatgatctttatggtaatggtaatacacactctcaaggagatgcccaaagattacgtccatgtctaacaggtctttttgatattcataaatttgatcttgttattaatggtcatgatcatgtttatacctcaacccatttcgttaaattccatgattcccaaaacaagatttacgatattgctaaaattagtaaaggttctgtaaatgaaaatcctaatggtactttctatgtcactgcaaattgttccacaggaagtaaattccttcctttttatgaaggagaacttgattacgtttttaattacaatcaaacgttcacctcaacttttggtgttttagatttccaaaaaagtgatggtaaagttacattaaccattaatacttatgaagtagatactcatgatgttgttgatggtccatacatttttaaaaaagatgaaagaag

SEQ ID NO: 25878 - DNA, 705 bp, Neocallimastix californiae
  Metallo-depent_PP-like
attattaaaaactattccatcggctacagccgtgggtaatcatgattcttttactgaaaatttcagacatcattttaatacacccaattcctatctcaatcctgaatataccgatattattccaggatataattatttctttaaatttaataatgttcttgttgttgttttagaaactaactatggtacttgtgatgattttacaaatgttatatctaaagccattaagaaatatccatcgacagattggagaattgctatgtttcatcatgatatttatggaaatggtgaatatcattcccaggatcctcaaattacagaagttttgcgtccatgcttaactaaattattatatagaaatgagtttgatcttgctattagtggtcatgaccatgtctattcagcctcacattttgtaacctatgataaagaaagtgaaaaaggatatgctgtaaatgaaattaaaaaaggaaatgtatataaaaatccaaagggaacattttatcttacagcaaattgttctaccggtagtaaactctacacttttattgataaaaaaccaagttatatttatcattacaaacaaactttttcttctacttttggtatattagaatttaaaaaggaatctggaaaagtaagattaactattaattcttatgaagttggtaccaataaagtaacggatggtccatatatttttga

SEQ ID NO: 25879 - DNA, 954 bp, Anaeromyces robustus
  Metallo-depent_PP-like
tcctgataatttcacagtagccttccttggtgatccacaaattggtggttctgcaggacatattccatatgaaaagaactttaaagatacattaagtatagaagaagcaacaagaaatgatgcttttaattggaatatgacaatttataaaatattcgaaaaaactgttaaaccaagtttaatattatcagctggggatcaaattgattatgatggaaatagaaaatcagaatatgatattgatattcaagaagaacaatatgctgctttctttttaccagaaaaattaaaacaagttccaattgctgaagctattggtaatcatgaatcaagattagatacctttaatttacattataatgtaccaaatccatatgatactccaattgaaccacaaattgcaccaggatatagttatttctttaaacataataatattcttgtagttgtattagaaactaatttcggtttttgtgaagattatcaagaagttatgagaagagcctataataaatatccagatacggattggcgtattgctttattccatcatgatatttatagtagtggttggtgtcattctcaagaagaatctgtcactgatttcttaagaccatgtttaactgaactttttactaaatataaatttgaccttgccattaatggacatgatcatatttattccacctctcattttgttacttttaatgaacaaaaaagtagtaaattgaagaaaaagtatgatcttcaaaaattagagaaaaatgttactaatgaaggtaataaaggtactttctttattactgcaaattgttctactggtagtaagctttatggttacaatgatgaaatcgatgattatcttagttactttaatcaaacttatacctcttcctttggtactatagatttcaaaaaggaagatggtaaagctaaaatgattattaatacttt

SEQ ID NO: 25880 - DNA, 990 bp, Anaeromyces robustus
  Metallo-depent_PP-like
aaataattttaactttatttttgttggtgatccacaaattggtggttcatataatcgtatttcagttgctgatcttactagaacactaactagagaagaaggtactagaaatgatgcatttaattggaatatgactgttaatagttcttttgaagtaactaaaacaccaagtgtattcttatctgctggtgatcaaatagatactgaatgttttacagttgatgattattcatattatttacaagaaactcaatattctgctttccttcttcctgaattattaaaatctattccatcagctactactgttggtaatcatgaatctttaaccaaaaatttcaaacatcattttaatactccaaattcttatcttacaccacttgaaaaagaccttgctccaggttataattatttctttaagtataataatgtacttgttgtagttcttgaaactaattatggtttttgtgatgatttcaaggaagtcatgagacaagcttacttaaaatatcctgatactgattggcgtattgctatgttccatcatgatatttatggtaatggtaaatatcattctcaagatgattatattacaatgaaattgcgtccatgtttaactgaattaatatctaaatataagtttgatcttgttataaatggtcatgatcatgtttattcagcatcttactttatctcctatgaggatagtgcaaaaggttatgatccaaaggaaattgtcaaagaaaaagtcaatgaaaatccaaatggaaccttttatattactggtaattgttcttctggtagtaaactttatggttatgttgaaaaagattttgattatgtttataattataatcaaacttatacttcttcttttggtactttggactttgaaaaagaagaagataaagttagattaactattaattattatgaagttgatactcatagaaagatagatggtccatacattatagaaaaatctgaaaa

SEQ ID NO: 25881 - DNA, 984 bp, Anaeromyces robustus
  Metallo-depent_PP-like
cataattgcatattttggtgatccacaaatcggtggttctaaaggtcgtctttctatagccaatccaacagaacctttaaatgtattcgaagcaacaagaaatgatgcatttaactggaataatacagtttataaagcttatgaattccaaggttttcaacaaccagatttttattttacagcaggtgataatgcagatgaacaagcctttcctgatgtctatgaaagtcaagaaagccaatattctgcatttctcttaccaaaaataatgcaacaaattcgtttagttcctgctttaggtaatcatgaaatcaatagtaaaaattttaagaatcattttaatgtaccaaatccatatgccgatgaagaagtaagaggacaaaattatcttccatcttatcattattactttaaacattataatattcttgttattgttcttgaaagtactacaggttttgattatgaatttgaagaaattatgtctcgtgccactaaatcatgtccagattgtgattggcgtatagttatgttccatcatgatatatatggtgctggtgaaacacatattaatgaagatcgtgtacaatatttacgaccagtattacttgaattattatctaaatataatattgatgtcgttatcaatggtcatgatcatgtttattctcaatcttatttccttaaatatgataaaaatagtagtactaagtatactaaacttgaaataccaaaagataaaacttattataatccagaaggtactttattcatcacagctaattgtgctactggaagtaaattatacagaactgcggaaaatgttgattacataaatactgcttcacaaactttcagtataaattctggatatttaatatttgatagaaatgaaaaaagagtatctttaacccttttctcttatgactttgataatgttaaacttattgatgaaatagtacaaataaataaaaaagctaaaac

SEQ ID NO: 25882 - DNA, 264 bp, Anaeromyces robustus
  Metallo-depent_PP-like
tgttgtacaatcagattctcgtactaaatatactaatccagatggtattattttctttgaagctagtacttcctcaggtagttcttatcattctttaatgaatgattacttcaaatatattgctagacgtggtcaacctttagatccactttacagtgttatggaaattactattgataaggaatctcttaaaacttccttaactttagatacttataaggtttctgataattctaaatatgataatggttatattattactaa

SEQ ID NO: 25883 - DNA, 690 bp, Anaeromyces robustus
  Metallo-depent_PP-like
agatagattaaaagtcataataggtggtgatccacaaattggtgctaatactaaaagagttgcatatataccagaaaaaggttggactcttcaaactggattagatgctgcaacaaatgatgcctttaattggcgtttaactttgaagaatgcttattctaaacatccagatacaagttttattattactgctggtgaccaaattcataattcagataataatcaacaagaaattgaatatgcaggtttcctttctaatccatatcttcgtgttttaccacttgcttcaactgttggtaatcatgatcatgccggtaattctattaatttcaagcatcatttcaataatcctataaaagtaacaaaggaagctggtgctgtaagttctggtccagattatttttattctcgtggtaaatcactttttattcatctcaatggtaataatttaaatattaaggatcataaaaatactattgatgaagctattggtgcctaccctaataatatttggagaattgttgttattcattttgatttatacggtcctgcttctcatcttaatgatgatactgttaaagttttacgtacaggattgactcctgttttctttgaaaccaaaattgatgttgttcttcaaggtcataatcatattcatgccagaactcatcttataactagagttgaagt

SEQ ID NO: 25884 - DNA, 1038 bp, Anaeromyces robustus
  Metallo-depent_PP-like
tcctaataattttaattttatttttgttggtgatccacaaattggtggttcacatggtcatatttcaactgttaaaaaaaatggtatagttactattgcagaagctattccaaatgatgcttttaattggaatgtaactatacaaagttcatttagttttgcaaaacaaccaagtttatttatttctgctggtgatcaagctgatactgatttaaaacgtgttcgtgaaaacgaaactaataaatataacagtaattgtattgaatataatgaacatcgtatattccaagaacaagaatattctgcattcctttatccaaatttattaaaaactattccagtagttgctgctgtaggtaatcatgatgcttatactactagttttagagaccattttaatactccaaattcatatcttacaccagaaaagccaatttcagttattacaccagataatggtaaaactagtagtataattccaggttataattatttcttcaagtataacaatgttcttgtcgttgttcttgaaactaattttggtactgaaaacgattttaaaactgttattgaaaatgccataaataaatatccaaatacagattggcgtattgctgtattccatcatgatatttatggtagtggatatactcattctcaagattggactatcgcagatccagattatggtatacgatcagtattaacaaaattattaaatgaaaataattttgatcttgctattaatggtcatgatcatgtttatacagcttcaaaatttatttcttatgatgaaaatagtaaaaagaaatatcatatggaagaaattgaaagtggtaaagtttataaagaaagaaaaggtactttatttattactgctaattgttctactggtagtaaactttatgatattgttcatccagatccagaatacgctcatgtatcaaaacaagattataaggttacttttggtattttaaatttctctaaaaagaatggaaccactacattagaaatatctactcatgatgttaagaa

SEQ ID NO: 25885 - DNA, 969 bp, Anaeromyces robustus
  Metallo-depent_PP-like
tccagataattttaaatttatttttgttggtgatccacaaattggtggttctcatagtcatgtagctcatggtatgagaagagttcttggtcttgatgatggtattagaaatgatgcctttaattggaaaagaactatttctaaagcctttgatcttactaaagaaccaagtcttgtattatctgctggtgatcaagctgattcaccctatgatttattatatagagaaattgaatattctgctcttttccttccagatcaattaaaaactgttccaatggctgctgctgttggtaatcatgatgctgaaagttttagtcatgatcttcattttaatgttccacatccatatcttactccagaatttcaaagtaaaattccaggatataattatttctttaaatttaataatgttcttgttgtagttctcgaaacaaactttattaccgaaaatgatgcagaagtagttatcaataatgctgttgaaacttatccagaaacagaatggcgtattgctttattccatcatgatatgtttggtaatggatatgctcattctcaatttgatgataccactcgtttacgtaaattcttaactgaattatttactaataataattttgatgttgtcattaatggtcatgatcatctttatacagcttctaaatttattacttatgatccaagtagaattgatgaaagtagtgaaaaatttactggttataatgttaccgttgttgaaaaggataaaatttatgaagatcctaaaggtactctttatattactgctaattgttcttctggtagtaaactttataccgaaacaggagataatgataaattagattatgtaaattatttcactcaaacttatacggctacttttggtgtattagattttgaaaaaattgatggaaaacttcaattaaaaattacttcctatgaagttgaaaattataatgaatttga

SEQ ID NO: 25886 - DNA, 1053 bp, Anaeromyces robustus
  Metallo-depent_PP-like
aaaaaatttcaaatttatttttgttggtgatccacaaattggtggtagtaataatcatcgtacttttaatgaaaatagttctcatttacttactgtaccagaaggtactagaaatgatgcatttaattggaatatgactatttataattcttttaaattaactcgtgaaccaagtcttttaatgtctgctggtgatcaagctgatagtgaatgttttaatcaaactttggaaaatttatataatcaagaaactcaattttcagcattattacttccagaaatattacaaactatcccatctgcatttactgttggtaaccacgaatcacatacagaaagttttaagtttcattttaatacaccaaatacttatcgtacaacagaatgtgaaagtgattctggattggaaatatgtaataatggtatttatgattatgatggtcctttcttcagtccaggttatagttatttctttaagtttaataatgtattagttgttgtacttgaaactaattttaatacatgtaatgatttaacaactgttatttcaaatgctgttgaaaaatataaagatatagattggcgtatagctatgtttcatcacgatatatatggtaatggtcaatatcattcccaagaaccatatattacagatgtattacgtccctgtttaactgaattatttgataaaaataaatttgatcttgttattaatggtcatgatcatgtatatactacatcacattttgttgctttttctgatgatagttatgggaaatatgcttatgatataaatgaaattaaaaaggataaagtttataaaaatcctaaaggcacattatatattactgctaattgttctactggtagtaaactttataattatataccagaaacaccggattatgtttattattataatcaaacttatacatctacttttggagttttagattttaaaaaagaaggtaaaacacctaagttaagtattacaacttacgatgttgaaactcttgaagtgacagatggtccatatattattgaaaaaccgga

SEQ ID NO: 25887 - DNA, 921 bp, Anaeromyces robustus
  Metallo-depent_PP-like
tccagataattttaaatttatattctttggtgatccacaaattggtggttctcatagtcatgtttcacttggtcaaagaagaattcttggtgttgacgatggtattagaaatgatgcttttagttggaatagaacgatttctaaatcttttgaatttactaaagaaccaagtcttatattatctgcaggggatcaagctgatgatgatgtagatgaattatatcaagaaatagaatattctgctttatttcttccagaattattaaaaactgttccattagctactgctgttggtaatcacgattcttatactattaattataggcaacatttccatgttccaaatccatatcttacaccagaatatcaatatactattcctggatatagttatttctttaaatataataatgttcttgttgtagtacttgaaactaattatattacagaaaatgatgcctatgaaataattccaaatgccgttaaaaaatatccagatactgattggcgtattgctttattccatcaagatctttatagtaatggatatacccattctcaacaatatgatgttcttcgtttacgtccatttttaactaaattattttctgaatataattttgatcttgtcattaatggtcatgatcatatttattcagcatcccaatttgtatcctatgataatattaatgattattataaagtttcttttattcaaagaggaaaacctcaagaaaatcctgaaggtactttatatattacagctaattgttctaccggtagtaaactttatggttttgaagatttcccattagattatatttattattttaatcaaactttttcatctacttttggtgttttagattttcaaaaagaaaatggaaaacatagattaaatattacttcttatgatgttga

SEQ ID NO: 25888 - DNA, 993 bp, Anaeromyces robustus
  Metallo-depent_PP-like
tccagataatttcacttttgtatttgttggtgatccacaaattggtggatctcatggacgtatttctgttgctgatattacaaaagctcttagtgttgaacaaggtactagaaatgatgtctttaactggaatatgacagttagtagctttttcaatttagttgatgaaccaagtttacttttatcagctggtgatcaagtagatgtacaatgttctacaaaaaatattgtttatgatgattataaccaagaaactcaatattctggttttcttcttccagaattattaaaaactattccaatggctgctgctcttggtaatcatgatgctacaagtaaaaattataggtatcatttcaaccttccaaatccttatcttactccagaaacaattggttatgaaattactggttataatttcttctttaaatataataatgtacttgttgtagttttagaatctaataattcatcatgtaatgatttcaaaacttctctaaaaaatgctatcaaaaaatatccaaatactgattggcgtattgctttattccatcatgatatttttggtaatggtgcaactcattctcaaggtggttcattagaattacgtccatgtttatcaaaattactttcaagttataaatttgatcttgttattaatggacatgatcatctttacactgcttcacattttatttcatataatgaaaaagctgaaaataaatatacagtttcaaaaattgaaaagggaaatgttaatgaaaatcctaaaggtacattatatattacagctaattgttctactggtagtaaactttatatcaatgatttattcccatatgattatgttaatgaatttgatcaaccatttaaatcaacttttggtcttttaaaatttgaaaaatctgaagaaaaagtaagattaattattaatacctatgatgttgatcaccataacgttacggatggtccatatattattgaaaaacaagc

SEQ ID NO: 25889 - DNA, 1050 bp, Anaeromyces robustus
  Metallo-depent_PP-like
tccaaataattttaaatttatttttgtaggagatcctcaaattggtgcttctcatgatcgtatttcatttgctaaaaatttacaagatgttttaaccatacctgaaagtaccagaaatgatgcttttaattggaatatgacaatttataaatcttttgaattcattaaagaaccaagtttattattatctgctggtgatcaaatagatatagcatgttcacctaaaacagaagaagatctttatttacaagaaactcaatattctggttttcttcttccagatttattaaaaactattccatctgttattgctgtaggtaatcatgaagcattaactcattcttttaaacatcattttaatccaccaaatccttatacaacccctattgaaccagaattagcaccaggttatagttatttttttaaatataataatattctttttgttatattagaaacaaattatggattttgtgatgattttaaagaagttatgagaagagcttatttaaaatatccaaatacagattggcgtattgctatgtttcatcatgatatttatagtaatggtagtaatcattctcaagaagaatatattgttagattcttaagaccatgtttaacggaattattatctaaatataaatttgatcttgtaattaatggtcatgatcatgcttattcttcttcccatttaatttcttttcatcaatatttaaataataacaatgacaataataataacaatactaatgataatgataataatagttataatttatacgatattcatgaaattaaaaaaggtgaaataaataaaaatgttaatggtaccctttacattagtagtaatagttcaacgggtagtaaactttatggttatgatgaaagagattttgattacatttcatattatcatcaaacttatacttcaacatttggtgttttagattttaaaaaggaaaaggataatgataatgtaagaatgacaataactcattatgaagttgatactcttcgtcaaattgatgaaccatatatttttgaaaa

SEQ ID NO: 25890 - DNA, 975 bp, Anaeromyces robustus
  Metallo-depent_PP-like
tccagataattttaaatttatttttgttggtgatccacaaattggtggttctgaaggacatgtaacctatgataatccaacagaacctctttctgaagtggatggtactaaaaatgatgcctttaattggaatatgaccattcataaatccttagaattaactaaagaacctagtcttttattatctgcaggtgatcaagttaatgccttttgtatggaaggatatgataaacaatatgaacttcaagaatatgaatattctgcattacttcttcctgatcccttaaaatctcttccaatggcaaccacggttggtaatcatgaaatttatactaaagcttttaaaaatcattatcatacaccaaattcttatgaaactccacttgaaccagatcttgccccaggttataattatttctttaaatataataatgttttagttattgtattggaaaccaattatgggtattgtgatgattttaaagaagttatgagaagagctcatttaaaatatcccaataccgattggcgtattgttatgttccatcatgatatttatagtaatggtaaattccattcccaagaatcctatattacagatactttaagaccatgtttatcccaattaatgacctattataaaatagatcttgtcattaatggtcatgatcatatttattctgcctcacgtttaattacatatgataaaaatgaagatttaggttttaaatcggttcaacttacaccaggtaaaaccaataaaaatgtcaaaggtacttattatgtgaccgctaattgttccacgggtagtaaacttttttcctttattgaagaatctaaagattatacgaataatttcaatcaaacctatacttccacctttggtgtcattgattttgaaaaggataaaaagagtcataccgttcaaatgacggttaattattatgaagtggatacccttcgtcaaattgatgg

SEQ ID NO: 25891 - DNA, 972 bp, Anaeromyces robustus
  Metallo-depent_PP-like
tccaaataatttccaatttatatttgttggtgatccacaaattggtggttctcatgatcgtttatctgttgctgatccttaccatgtattaacacgtgaagaaggtactagaaatgatgcttttaattggaatatgacaatttataaatcctttgaaaaaacaggaaagccaagtgtattattatctgctggggatcaagtggatacggaatgtttttctggtaccactgaagaagattatagtcaagaaattcaatattcggctttccttcttccagatttattaaaaactattccatccgctacaaccgttggtaatcatgaagctttaaataaaaattatagaaatcattataatactccaaattcacatattccattagaacctgaaattgcacctggttatagttatttctttaaatataataatgttttagtggttgttttagaaacgaattatagtttttgtgatgattttaaagccgttttcaaaaaagcttttttaaaatatccaaataccgattggcgtgtggctatgttccatcatgatatttatggtaatggtagtttccattcccaagatgaatatattattaataaattacgtccatgtttaacggaattactttcttactacaaatttgatttagttattaatggtcatgatcatattttctctgcctcaaaatttgtttcttataaaaagggtaataaatatagtttaagtaatatacaaaagggaaaggtgaataaaaatgccaaaggtactttttatattactgctaattgttcaaccggtagtaaactttttggattcattaatcaagattttgattataattataattttagtcaaacgtatacttctgcttttggggtattagattttcaaaaaagtaatggtaaagttaaattaactgttaattattatgaagtagataccttacgtcaaattgatggtccttacatctt

SEQ ID NO: 25892 - DNA, 957 bp, Anaeromyces robustus
  Metallo-depent_PP-like
ttttaaatttattttccttggtgatccacaaattggtggttctcatagtcatgtagctcatggtatgagaagagttcttggtcttgatgatgctattagaaatgatgcctttaattggaaaagaactatttctaaagcttttgaatttactaaagaaccaagtcttatattatctgctggtgatcaagcagatacagaacaagatttattatatagagaaattgaatattctgctcttttccttccagatcaattaaaaactgttcctatggctgctgctgttggtaatcatgatgcttggagttttagtcataaacttcattttaatgtaccaaatccatatcttactccagattatagttactttattccaggttatagttatttctttaaatataataatgcccttgtagtcgttcttgaaacaaattatcttactgaaaatgatgctaatgctgtgatcactaatgctgttaaaacttatccaaatacagattggcgtattgctttattccatcatgatatgtatggtaatggagaagtacattctcaaaataatgatgccacttctttacgtccctatttaacaaaattatttacggaatatcaatttgatgttaccattaatggacatgatcatgtttatactgcttcaaaaattgtagcttatgatccaagtaaaattgatgaaagtagtgaaatatttactggttataatactacaactattgaaaaaggaaaagtttatcaaaatccaaaaggtactctttatgttaccgctaattgttcttctggtagtaaacttttcaaaaatttgaaaaaaaatattgattatgttaattattctactcaaacttattctgctacttttggtgttttagattttgaaaaggtcaatggaaaacttagattaaatattacttcctatgaagttgaagattataatattgttgatgg

SEQ ID NO: 25893 - DNA, 984 bp, Piromyces finnis
  Metallo-depent_PP-like
agataactttaaaatcctttttgttggtgacccacaaattggtggtgctcacgacagaattactgcttcaaataattactctagagttctcacaagagaagaaggtaatagaaatgatgcttttaactggaatgttactgtatataattcatttaattttgctggtcaaccaagtcttttattatctgcaggtgatcaagccgatgaagaatatgccgtaaaaggtaatgaatacgattataatgaagaatcccaatattctgcttttcttcttccaaaattaatgcaaaccattccaactgtacctacaatcggtaatcatgatagttacacagaaaactttaaatatcatttcaacacaccaaataattatgcttctaaaaattatacaaagtattataatggaaatgaaccaggatacaattatttctttaaatataataacattttatttgttgttcttaacaccaacgctccaatttgtgaagagtttaccgaaattattaataaggctatcactaaatatcccgatacagactggcgtattgccatgttccaccaagatctttatggtgatggtagtactcattctcaaaatgatggtatcacaaaagtattacgtccttgccttacaaaattaatttatgataacaaattcgatcttgttcttaacggtcatgatcacgtttataccgtaagtaaatttattacctacacaggagctgataattatggtggttatggttttaattctattgaaagaaataaggtttaccataagccagatggaacactttatattacagccaattgttctactggtaacaaactttacaagtatgttaagccacaacttgactatgtttattaccatgatcaaacttatactccgacttttggtgttatggatttcaagaaaagtgatggaaaggttactatgactattaatacctatgatgttgaatctcataaacttgttgatgg

SEQ ID NO: 25894 - DNA, 561 bp, Piromyces finnis
  Metallo-depent_PP-like
taataatgttcttgttgtagtacttgaaaccaactacggttattgtgatgactttaaagaagttttaagacaagctcatgcaaagtatccaaatacagattggagaattgctatgttccatcataatatctatggcaatggtaaataccattctcaggattatcacattacagatgtattacgtccatgtttaacagaacttctttctaattataaatttgatcttgttattaatggtcatgatcatatttatacagcatcttactttatttcatacagtaacaatgataaaggttacactccagaaaaaattagtcaaaatagaatttatgaaaatccaaagggtactttttacattactgctaattgctctacaggtagtaaactctatgaaagtattgataggacgatggattatgtttataattatggtcaaaattatttatcatcctttggtgtcctagactttagtaaagaagatggaaaggtaaaattaactatttcaaattatgacgttgatactggtaataaggttgatggagattatatcattcaaaagcc

SEQ ID NO: 25895 - DNA, 300 bp, Piromyces finnis
  Metallo-depent_PP-like
tggtcatgatcatgtttacactgcttctaaattcatttcttataccggagctgataatcttggtggttatacaccttctgagattgtaacaaataaagctattagagatccaaagggtactttatatattacagctaattgttccactggtagtaaattatatgattattatcaaggtgaaattgatattgattatgttcatttttacaatcaaacatttactgccacttttggtgttttggattttgaaaaagaggatgatattgttagaatgagtattactacatatgatgttaattc

SEQ ID NO: 25896 - DNA, 354 bp, Piromyces finnis
  Metallo-depent_PP-like
tgtcattaatggtcatgatcacgtctacaccacaactaaatttgtttcttacgttaaaaagagtaatgattacaattcaccagataattatcaagttgacccaatagaaagaaatgttgttaataaaaatccaaagggtacattctatgttaccgctaattgttcttctggtgctaaatatttagactttttgaaagatccaaatgtagattatgtttacagttttaatcaaacctatactcaaacatttggtatattagatttcactcaagcaaacggtaaagttcgtttagaaattaccacttatgatgctgaaacttatgatgttatcgatggttcttacattattgaaaa

SEQ ID NO: 25897 - DNA, 411 bp, Piromyces finnis
  Metallo-depent_PP-like
tgataaaaatttcaaatttatttttatgggtgatgctcaaattggtggttcccatggtcgttacagatcatatcctcaattccaataccgtacaacagatgatgaaggtaacagaaatgatgtctttaattggaatagagttgtcaatagtgcctttaaattttcaaaaacaccaagtgtattattatctgctggtgatcaagcagatgattcaagatcttttaatgatgatagaaaatacctttataaaaaaatgactaatattgaatcccaatattctggttttctctacccagaattattaaaacatattgtcacagcaactagtgttggtaatcacgaaaccacttcaaatggttttggacgtcgctttaatactccaaattcattaaaaaattgtactcttaccaa

SEQ ID NO: 25898 - DNA, 441 bp, Piromyces finnis
  Metallo-depent_PP-like
catgttccatcatgatatttatggcaatggtagtacacattcatcagataccgatattacctcaaagttacgtccatgtcttacccgtttaatggatcattatcattttgatttggtacttaatggtcatgatcatgtttacaccgtttctaattttattcattataagggtacggataatgatcaaatggaaggttattacggcgtatcttccattaaaaaggaagaagtaaataaaaatgtcaatggtacattgtatatcacttctaattgttccactggtagtaaactttatggattctcctctaatcctaatagagattatgtttataggtataatcaaacgtatagttccacttttggtgtattggattttaacacaacggataccactacaatgctttctattacgatttatgaagtagattccatggaagtctc

SEQ ID NO: 25899 - DNA, 588 bp, Piromyces finnis
  Metallo-depent_PP-like
caaaaaatttaaatttatttttgttggtgatcctcaaattggtggttccaaaaatcgttttgcttttcgacctggcggtaaaagtaaaaaatttgttatggaggaagctattcgaaatgatgccttcaactggaacatgaccattgtaaattcatttaagattgccggaaatgaaccaagtttattattatctgctggggatcaagcagaaactatggcagatgattggtctgaagccaattatcttgaacaagaaacccaatattctgctttccttcttccagaattattgaaacaatttccttcagcaaccgccattggtaatcatgattctcttactgtaaactatagaaatcatttcaatacccctaattcctttaccaacccatcctataaggacagttggaagggtagtcgatgggaaggatttattcctggttatagttattatttcaaatataataatgtcgttgtggttgttctcgaaaccaactattctgattgtaccgattttgaaaccgtcattaaggaagccctcaccaagtatccagaggccaattggcgtattgccatgttccatcatgatat

SEQ ID NO: 25900 - DNA, 591 bp, Piromyces finnis
  Metallo-depent_PP-like
tccagataactttaaatttatttttgttggtgatcctcaaattggtggttccaaaaatcgttttgcttttcgacctggcggtaaaagtaaaaaatttgttatggaggaagctattcgaaatgatgccttcaactggaacatgaccattgtaaattcatttaagattgccggaaatgaaccaagtttattattatctgctggggatcaagcagaaactatggcagatgattggtctgaagccaattatcttgaacaagaaacccaatattctgctttccttcttccagaattattgaaacaatttccttcagcaaccgccattggtaatcatgattctcttactgtaaactatagaaatcatttcaatacccctaattcctttaccaacccatcctataaggacagttggaagggtagtcgatgggaaggatttattcctggttatagttattatttcaaatataataatgtcgttgtggttgttctcgaaaccaactattctgattgtaccgattttgaaaccgtcattaaggaagccctcaccaagtatccagaggccaattggcgtattgccatgttccatcatgatat

SEQ ID NO: 25901 - DNA, 993 bp, Piromyces finnis
  Metallo-depent_PP-like
tccagataactttaaatttatttttgttggtgatccacaaattggtggttcacatgaccgttactccatttctaatttatatgagagagtattaacggtggatgagggtacagccaatgatgcctttaattggaatagaactattacccattcctttgattttgttaaagaaccaagtcttttattatctgctggtgatcaagctgatgaagaaaacaatagtttctatagtgatcaagaacattataatgaagaaacacaatactctgcattacttctccctaaacaaattcaaaccattccaatggctgctgctatcggtaatcatgacagaaatactgaaaatttcagacatcattttaacgtacctaatccatataaaaatccatcctatcttatggatgatggatggattgaaggttacaactattactttaaatacaataatgttttaattgtagttcttaacaccaatcatgaagaatgtgttgattttgaatccgtcattaccaatgccgttgaaaaatatccagacactttatggcgtattgctttattccatcatgatatttatggtaatggtgttactcattccttagaagatggtatgaagaatgttttacgtccatgtttaaccaaattattatccaattttaaatttgatcttgccattagtggacatgatcacgtctataccgcaagtaaatttattacctacgatgctaatgctaataattctggtaaatatgtaacaagtgacattcaaaccaatgaaacctttaaggatccaaagggtaccttttttattactgctaattgttcctctggtagtaaactttacagttttgttgaagataccccagattttgttcacgaagatattcaaagctttacctctacttttggtactttggattttaccaaggaatacggtaaagctacattaaaaattgttacttatgatgtagaatcaccagataccatcattgatgg

SEQ ID NO: 25902 - DNA, 978 bp, Piromyces finnis
  Metallo-depent_PP-like
tccttacaattttaaatttgtatttgttggtgatcctcaaattggaggttctcacgatcgtttttccatcaccaataattatgaaagggttctcacgttgaatgaaggtaatagaaatgacgcattcaattggaatagaactatttctagatcttttgaatttgcaaataaaccaagtctcctacttagtgctggggatcaagccgatgaagaatgtaaacacttggaagataatgaaaaaggacccatggaacttttgaatgaagaaatgcaatattcagcttttcttcttccagatttattaaaatctgtacctgtcgctgctgcagttggtaatcatgatgctagtaataataattttagaaaacattttaattcaccaaattcctacaccgaccccaaataccaagatttaattccgggatataattatttctttagacatcataatgttcttgtcgttgttctcgaaacgaactacgggtattgtgaagatttttccaatgtaattgaaaaggccataaaaaaatatccagacgttgattggcgtattgcaatgtttcatcatgatatctacggtaatggtgtaacccattcgaaggaaccttacattgtcaatgaattacgtccatgtttaacccaattattttatgaaaataaatttgatcttgtgattaacggacatgatcatgtctataccgcttcaaagttcatttcctatgataacaataactacagtgtaagtgatataaaaaagaataaagtttataagcaacccaaaggtactttttacattaccgctaattgttcaaccggtagtaaactttatgattattataaagaagatttggattatgtttatcaaaatagtcaaacctttagtgccacttttggtatattagatttcaaggtagaagatggaataaccaaattatctattgcttcctatgatgttgaaacatacgaaattatagatgg

SEQ ID NO: 25903 - DNA, 978 bp, Piromyces finnis; identical to SEQ ID NO: 25902
  Metallo-depent_PP-like

SEQ ID NO: 25904 - DNA, 972 bp, Piromyces finnis
  Metallo-depent_PP-like
cgatcattttaatttcattttccttggtgatcctcaaattggcggttctaagaatcgttacagtaaacttcttaaggatagaggggtcaccatcgaagaaggtattagaaatgatgcatttaactggaatagaaccctgaccgaagccgtaaactatgtcaaaactccaagtcttatcttatcagcaggggatcaagcagaatctatggcttacgattctgatgaagaacttattttacaagaaaaagaatatgctgcttttcttactccaaatttaattcaatccattcctactgccgctaccgttggtaatcatgatcaatatacggataattttattcatcattttaatccaccaaatttatacaatcaagatactgttcttcaaaccaccggtacgcgtgtccttcccggttacaactattactttaaatataataatgtacttgttgtggtacttgacaccaacaatcacaattgtaccgatttttctacggttatcgaagaagccattgaaaaacatccaaagacggattggcgaattgccatgttccatcatgatatttacggtaatggtagtactcattcttccgaagatgatattaaactttacttacgtccatgcctaactccattgattgataaggctcattttgatcttgtcattaatggtcatgatcatgtctactcctcttctaaatttatttcctacaatgatgatggaagtctctattcgttgaacgacattgaaaccaataaaatttatgaaaatcaaaatggtaccctttaccttacggcaaattgttctaccggtagtaaactttacggattttcttccattaaaaactacacctcctactacaaacaaacctttacctctaattttggggtattagattttgaaaatgttgatggtaaaactcgattaagtattaccacattggaagtggaatcaaaaaatattgttgatgg

SEQ ID NO: 25905 - DNA, 972 bp, Piromyces finnis; identical to SEQ ID NO: 25904
  Metallo-depent_PP-like

SEQ ID NO: 25906 - DNA, 972 bp, Piromyces finnis; identical to SEQ ID NO: 25904
  Metallo-depent_PP-like

SEQ ID NO: 25907 - DNA, 972 bp, Piromyces finnis; identical to SEQ ID NO: 25904
  Metallo-depent_PP-like

SEQ ID NO: 25908 - DNA, 690 bp, Neocallimastix californiae
  Metallophos
cagatttgttttccttggagatccacaaatcggtgcatccaaaaataacttttcagttttaacggagcaacgtcttactgaggaagaaggtcttagaaatgatgctttcaattggaatatgactatatataattcttatgcaaaagcaaatgaagcaagtattattttatctgctggtgataatgctgattctggtcaatctccaggtgattctagcggtaaaactgaagaatatattagaaatgatcttctcagacaagaaagagaatattcaaccttattacttcctaaattaatgcaacaggttccatttgctccagctgttggtaatcatgaatcttttactccttcttttagataccattttaatactccaaatccataccttataggtaaaactgaaacaagtcctggttatagttatttctttaaacataataatgtacttgttatcgttctcgaaactaattatggtaccgaggaagaatttagagaagtagtaggaaaagctaattcaacttttccagatgttgattggagagttgctttattccatcatgatatttatagtaatggttatacacattcacaagatcctttaattaccgaatatatacgtaaagaagtaactcaattgtttgatatatatgatattgatcttgttattaatggtcatgatcatatgtatgc

SEQ ID NO: 25909 - DNA, 654 bp, Neocallimastix californiae
  Metallophos
caaatttgtatttgtcggagatccacaaattggaggttccgtttctagagttggttatcatacttctaaaacttttgattattcagaagctgtaagaaatgacgcttttaattggaacgttactgttaatagtttctttaaaaaaacgggtaatccaagtcttttattatccgctggtgatcaagctgatactatgggtgaagatgaatcacaagaacaacaatattctggtcttcttcttccagaattaattaaaaccataccaattgctccagctcttggtaatcatgaagtatactctgaaagttttagacatcacttcaatgttccaaatccatacaaaccaaagaaattggatactttatcacgtatttcagcctataattattatttcaaatataataatgttcttgtcgttgttcttgaatccaatcataatacttgccatgattgtgaaatggttatttcaaatgctatagatgaatatccggacactgattggcgtattgctttattccatcatgatctttatggtaacggaaaaactcactctcaaggtagtagtgacggtaaaagattacgtgcttgcttaactggactttttgatatttataactttgatcttgttattaatggtcatgatcacgtttacac

SEQ ID NO: 25910 - DNA, 687 bp, Neocallimastix californiae
  Metallophos
tagatttattttccttggtgacccacaaattggtgcttctgctggtgccatctctgaacttcatcttaataaagttctttctgacgatgaaggtctcagaaatgatgccttcaattggaatatgactatttataattcctatgaaaaagcaaatggacctagtcttatcctttctgctggtgataatgccgattctggtcaatcaccaagtaatgaaaatagtaaaatcgaagatattaaaaaagatcttattagacaagaaaagcaatattctgctcttttacttccaagtttaatgcaaaaagttccatttgccactgctcttggtaatcatgaatcctattctccttccttcaaatatcactttaataatccaaacccttataaggtagaaagatcagaatttagtccaggctataactatttcttcaaatataataatgcccttgttgttatgcttgaatctaactatggtattaaagatgattattcagatgtcatttctaatgccacttctacttatccagatactgattggagaattgctgtattccatcatgatatctacagtaatggtgttatgcattccagtgaatacagagttactgaattacgtaagtggttaaccccattgtttgatgaatatgattttgatcttgttattaacggtcatgatcatatgtattc

SEQ ID NO: 25911 - DNA, 660 bp, Neocallimastix californiae
  Metallophos
ttttatttttgttggtgatccacaaattggtggttcaaacgatcgtattatctatgattcaagagaaagccaaggttattctttagctattaaaaatgatgcttttaattggaatatgacaatttatagttcttttgaaatgacaaaaaatccaagtcttttattatctgctggtgataatgctgataccgaaaattattatagcagtatagattattacaatcaagaatctgaatattctgcttttcttcttcctgaattaataaaaactattccaatagctccagctcttggtaaccacgaaacaaaaactgaaggttataaataccatttcaatccaccaaatacttactctacaaaaagatttgaacaaatgagtttagtaccagcatacagttatttctttaaatataacaatgttcttgtcgttgttttagaatctaataaaagtagctgtattgattgtgaaataatcttttcaaaagcagtaaaaaagtatccagatactgattggcgtattgctttgttccatcatgatgtttatggtaatggtaaaactcactcccaaggggatgctttaagattacgtccatgcttaactggtcttttcagtatctataaatttgatgttgtaattaatggacatgatcatgtctatac

SEQ ID NO: 25912 - DNA, 726 bp, Neocallimastix californiae
  Metallophos
cagatttgtttttcttggtgatccacaaattggttcatctcgtggtagttattcaattggtaatcgtaaacaatttagtgatgatgaaggtcttagaaacgatgcttttaattggaatatgactatattcaattcttattcaaaagcaaatgaagctagtcttattttatccgctggtgataatgctgattctggtgaaacgccaagtaatggtgatattttagataatattagtaatattagtaaaatgtccactgatcttctcagacaagaaaaagaatattcatctttattacttccagaattaatgcaaaaagttccatttgttcctgctgttggtaatcatgaatcttatactgctacatatagatatcattttaatactccaaattcatataaggtagagagtgaaaatcaaattccaggatataattacacaagtattacacctggttacaactattactttaaacataataatgtccttattgttgttctcgaatctaattatggaaatgaagaaatatatacaactgtaatgaatatggctaatgacgcttatcctgatgttgattggagaattgctttgtttcatcatgatatttttagtgatggttacatccattcagaagaaggtcgtgttcaagaattacgtcaatggttaactccattatttgataaatttaattttgatctagttattaatggtcatgatcatatgtattc

SEQ ID NO: 25913 - DNA, 642 bp, Neocallimastix californiae
  Metallophos
atttgttttcgttggagatccgcaaattggtggttctaatgatcgtcttgcttatcaatcaaattctagaatgaatagtgattctattagaaatgatgcctttaattggaatatgacggtcaatagtttctatgaattaactggaaaaccaagtcttttattatctgctggtgatcaagctgatcaaatgggtaatgataaaactcaagaaagacaatattctgcctatcttcttccagaattaatcaagaaaattccaattgcacctgctcttggtaatcatgaagtttattctgaaagtttcagacgtcatttcaatgttccaaatcctatacttaaaaaaagattttattctaataagcctgtttcagcttataattattactttaaatataataatgttcttgttgttgttattgaaacaaattacaatacctgtcatgaatgtgaaaaagtaatttcagaggctgttaaacaatatccatctgctgattggcgtgttgctttattccatcacgatctttatggtaatggtaaaactcactctcaaggagatgctcaaaaattacgtccatgtttaacaggtctttttgatatttatcactttgatcttgttattaatggtcatgatcatgtttatac

SEQ ID NO: 25914 - DNA, 645 bp, Neocallimastix californiae
  Metallophos
atttattttccttggtgatccacaaattggtggttcaataggtagacatcaatatcattcgtcggattattttgattatgctgaagccattagaaatgatgctttcaattggaatataacgatttttaattccattaaatttactaaaactcctagtcttatattatctgctggagatcaagccgataccatgggtgatgatatcactcaagaacagcaatattcaggtcttcttcttccagaattgataaagactattccatttgctcctacacttggtaaccatgaagtattttctgaaagttttagacgtcattttaatgttccacatccatatatcccaaagaaatatgatgatttagattatgttcctgcatataactactactttaaatataataatgttttagttgttgttctagaaagtaatcataattcctgtcacgattgtgaaatagttatggctaaagctgttgataaatatccaaatacagattggagaatcgctttattccatcatgatatttatggtaatggtgctactcattcccaaggtgacgcaaagaaattaagaccatgtttaactggtctttttgatatttataaatttgatcttgtaattaatggtcatgaccatgtttatac

SEQ ID NO: 25915 - DNA, 702 bp, Neocallimastix californiae
  Metallophos
cagatttgtttttcttggtgatccacaaatcggtgcatctcgtaatcttatttctggtaaaaagtcccttacagatgatgaaggtcttagaaatgatgcgttcaattggaacatgactatatataactcttatgaatttgctaatgaacctagtcttattttatctgctggagataatgctgattctggtcagtcaccaggtgatgataaaaaatctgaagaaaatattaaaattgatctcctaagacaggaaagagaatattccactttattacttccacagataatgcaaaaagttccatttgcttctgctattggtaatcatgaatcttttactcctacttttaggtatcattttaatactccacattcctataaagttgaaagtgataatttcatcaaaggatttcaatccagtataactcctggctataattatttctttaaatataataacgtacttatcgttgtattagaatccaattacagtacggaggaacagtatagagaagttattgaaaatgctattactacctatccagaaacagattggagaattggcttattccatcatgatatttatagtaatggttatggtcattccactgaaccacgtgtcatggatttaagaaaatggttaacaccaatgcttgataagtatgattttgatcttgttattaatggtcatgatcatgtctatgt

SEQ ID NO: 25916 - DNA, 684 bp, Neocallimastix californiae
  Metallophos
ttttatttttttaggggatcctcaaattggtggttctaacagtcgtcattccgccttggatcctactcgaccacttacagtggaggaaggtactagaaatgatgcttttaattggaacagaacaattacaaattcattccaatttactcgtgaacccagtgttattatgacagcaggtgatcaagcagattcaatgtgtattgattctaaccttgatgaaatttataatcaagaaactcaatactctgctttccttcttccagaattaatgcaaaagattccaaccgcaaccactgttggtaatcatgactccttcacaacaaattatagaaatcattttaatccaccaaacacttacactaccccggaatatgttatggctaatggattttcaggagtaataccaggatatagttatttctttaaatataataatgtccttgtggtcgtgctagaaaccaattataataattgtaatgattttgaaaacgttattaataaggccattgagaaatatccatataccgattggcgtattgccatgtttcatcatgatatatatggtgatggttatattcattcgacggaggattatattactaaatatttacgtccatgtttaactggtattttcaccgataaaaaatttgatcttgttattaatggtcatgatcatgtctatac

SEQ ID NO: 25917 - DNA, 711 bp, Neocallimastix californiae
  Metallophos
cagatttattttccttggtgatccacagattggagcttctcataatgtcctttccattgataaatatattgatgatgatgaaagtcttaggaacgatgccttcaattggaatatgacgatatacaattcttattcaaaagcaaatgaagcaagtcttattttatctgcaggagataatactgactctggtcaatctccaagtgatagagatattttgagatatccagacgaattggaatatgatctcataaaacaagaaaaagagtattcatccttactgcttccagaattaatgcaaaaagttccatttgcttcagctgttggtaatcatgaatcgtttactgcttcttttagataccattttaatactccaaattcgttagaggttgaaagtaataatcaaattccaggatatgattatgctagcgttaccccaggctatagctacttctttaaatataataatgtacttattatcgttctcgaatctaattatggtactgaagaacaatatgaaacattattggaaaaggcatgctcaacctatccaggtgttgattggagaatcgcattatttcatcatgatatttatagtaatggatttaatcactcagaggaagaaagagttttattacttcgtcaatggcttacaaaattactttataaaaataaaattgatcttgttattaatggtcatgatcatatttattc

SEQ ID NO: 25918 - DNA, 663 bp, Neocallimastix californiae
  Metallophos
ctttatatttgtaggtgatccacaaattggtggttcacatggtaaacctaatttcttagatatgtccaaagaacttactaacgatgaagctacaagaaatgatgcttttaattgggaacgtacaatgaataaagctttcgaattaaaaagtaataatcctccaagtcttttattatcagctggtgatcaagctgatgatgaaaaacttcaagattatttagatgaaactcaattttcagccttacttcaacctgctgtattaaagggaattccacatgctatgactgttggtaatcacgaacaatataacgaaaatttcagacatcactttaatactccaaattcttttactgaaatagaacgctctgaccgtgaagtcattcctggttttaattacttctttagatttaataatgtattagttgttgttcttgatactaatgaaccttctacttatgactattctcatactatgaaaaatgcagttacaaaatatccagatactacttggcgtattgtaatgtttcatcatgatcttttcggtattggtagaacccattcacaaggaacttatattgttaataaattaagacctattttaaacccattattagcaaagtataaagttgatcttgttattaatggtcacgatcattattattc

SEQ ID NO: 25919 - DNA, 669 bp, Neocallimastix californiae
  Metallophos
taaatttgcttttgttggtgatccccaaattggaggttctaatgaacgtcttgcctataaatcaaatttactaatgggaggtagtgacggtatgagaaatgatgcctttaattggaatgtaaccgttaatagtttttttaagcaaacagaacttatgccaagtcttttattatctgctggtgatcaagtagattttgtaggggatgacttggatttagaacaacaatactctgcctatcttcttccagaattaatgaaatctcttccagttgctccaactttaggtaatcatgaaaaatatagtaatagttttagacgtcattttaatgttccaaatccatatattccaaataaattaaaggatatgagtaatgataatatctatcccatatcctcttacaattacttctttaaatataataatgttcttgtggttgttcttgaaagcaatcgtaattcttgtttagattgtgaaatggtaatatcaaacgcagttaataagtatccagaggctgattggcgtattgctttattccatcatgatctttatggtaatggaaaaactcattcccaaggtatagaagattctctgcgattaagatcatgtttgactggtctctttgatatttacaaatttgatcttgtcattaatggtcatgatcatgtcca

SEQ ID NO: 25920 - DNA, 639 bp, Neocallimastix californiae
  Metallophos
atttgtattcgttggagatccacaaattggtggttctaatgatcgtcttgcatataaatcaaaatccaaaatgaatgagagttccattggaaatgatgcctttaattggaatatgacggttaatagtttctatgaattaactggtaaaccaagtcttttattatctgctggtgatcaagctgattatatgggcggtgataaaactcaagaaagacaatattctgcctatcttcttccagatttaatcaagaaaattccaattgctcctgctcttggtaatcatgaagtttattctgaaagtttcagacgtcatttcaatgttccaaatcctatgtttaatgcgttacattataaaaccagttactcagcttataattattactttaaatataataatgttcttgttgttgttattgaatcaaattacaatacatgtcatcaatgtgaaaaaataatttcaaaagctgttaaggaatacccagatgctgattggagaattgctttatttcaccatgatctttatggtaatggtaatacacactctcaaggagatgcccaaagattacgtccatgtctaacaggtctttttgatattcataaatttgatcttgttattaatggtcatgatcatgtttatac

SEQ ID NO: 25921 - DNA, 405 bp, Neocallimastix californiae
  Metallophos
agaattattaaaaactattccatcggctacagccgtgggtaatcatgattcttttactgaaaatttcagacatcattttaatacacccaattcctatctcaatcctgaatataccgatattattccaggatataattatttctttaaatttaataatgttcttgttgttgttttagaaactaactatggtacttgtgatgattttacaaatgttatatctaaagccattaagaaatatccatcgacagattggagaattgctatgtttcatcatgatatttatggaaatggtgaatatcattcccaggatcctcaaattacagaagttttgcgtccatgcttaactaaattattatatagaaatgagtttgatcttgctattagtggtcatgaccatgtctattc

SEQ ID NO: 25922 - DNA, 672 bp, Anaeromyces robustus
  Metallophos
cacagtagccttccttggtgatccacaaattggtggttctgcaggacatattccatatgaaaagaactttaaagatacattaagtatagaagaagcaacaagaaatgatgcttttaattggaatatgacaatttataaaatattcgaaaaaactgttaaaccaagtttaatattatcagctggggatcaaattgattatgatggaaatagaaaatcagaatatgatattgatattcaagaagaacaatatgctgctttctttttaccagaaaaattaaaacaagttccaattgctgaagctattggtaatcatgaatcaagattagatacctttaatttacattataatgtaccaaatccatatgatactccaattgaaccacaaattgcaccaggatatagttatttctttaaacataataatattcttgtagttgtattagaaactaatttcggtttttgtgaagattatcaagaagttatgagaagagcctataataaatatccagatacggattggcgtattgctttattccatcatgatatttatagtagtggttggtgtcattctcaagaagaatctgtcactgatttcttaagaccatgtttaactgaactttttactaaatataaatttgaccttgccattaatggacatgatcatatttattc

SEQ ID NO: 25923 - DNA, 438 bp, Anaeromyces robustus
  Metallophos
acaagaaactcaatattctgctttccttcttcctgaattattaaaatctattccatcagctactactgttggtaatcatgaatctttaaccaaaaatttcaaacatcattttaatactccaaattcttatcttacaccacttgaaaaagaccttgctccaggttataattatttctttaagtataataatgtacttgttgtagttcttgaaactaattatggtttttgtgatgatttcaaggaagtcatgagacaagcttacttaaaatatcctgatactgattggcgtattgctatgttccatcatgatatttatggtaatggtaaatatcattctcaagatgattatattacaatgaaattgcgtccatgtttaactgaattaatatctaaatataagtttgatcttgttataaatggtcatgatcatgtttattc

SEQ ID NO: 25924 - DNA, 654 bp, Anaeromyces robustus
  Metallophos
tggtgatccacaaatcggtggttctaaaggtcgtctttctatagccaatccaacagaacctttaaatgtattcgaagcaacaagaaatgatgcatttaactggaataatacagtttataaagcttatgaattccaaggttttcaacaaccagatttttattttacagcaggtgataatgcagatgaacaagcctttcctgatgtctatgaaagtcaagaaagccaatattctgcatttctcttaccaaaaataatgcaacaaattcgtttagttcctgctttaggtaatcatgaaatcaatagtaaaaattttaagaatcattttaatgtaccaaatccatatgccgatgaagaagtaagaggacaaaattatcttccatcttatcattattactttaaacattataatattcttgttattgttcttgaaagtactacaggttttgattatgaatttgaagaaattatgtctcgtgccactaaatcatgtccagattgtgattggcgtatagttatgttccatcatgatatatatggtgctggtgaaacacatattaatgaagatcgtgtacaatatttacgaccagtattacttgaattattatctaaatataatattgatgtcgttatcaatggtcatgatcatgtttattc

SEQ ID NO: 25925 - DNA, 519 bp, Anaeromyces robustus
  Metallophos
aactttgaagaatgcttattctaaacatccagatacaagttttattattactgctggtgaccaaattcataattcagataataatcaacaagaaattgaatatgcaggtttcctttctaatccatatcttcgtgttttaccacttgcttcaactgttggtaatcatgatcatgccggtaattctattaatttcaagcatcatttcaataatcctataaaagtaacaaaggaagctggtgctgtaagttctggtccagattatttttattctcgtggtaaatcactttttattcatctcaatggtaataatttaaatattaaggatcataaaaatactattgatgaagctattggtgcctaccctaataatatttggagaattgttgttattcattttgatttatacggtcctgcttctcatcttaatgatgatactgttaaagttttacgtacaggattgactcctgttttctttgaaaccaaaattgatgttgttcttcaaggtcataatcatattca

SEQ ID NO: 25926 - DNA, 753 bp, Anaeromyces robustus
  Metallophos
ttttatttttgttggtgatccacaaattggtggttcacatggtcatatttcaactgttaaaaaaaatggtatagttactattgcagaagctattccaaatgatgcttttaattggaatgtaactatacaaagttcatttagttttgcaaaacaaccaagtttatttatttctgctggtgatcaagctgatactgatttaaaacgtgttcgtgaaaacgaaactaataaatataacagtaattgtattgaatataatgaacatcgtatattccaagaacaagaatattctgcattcctttatccaaatttattaaaaactattccagtagttgctgctgtaggtaatcatgatgcttatactactagttttagagaccattttaatactccaaattcatatcttacaccagaaaagccaatttcagttattacaccagataatggtaaaactagtagtataattccaggttataattatttcttcaagtataacaatgttcttgtcgttgttcttgaaactaattttggtactgaaaacgattttaaaactgttattgaaaatgccataaataaatatccaaatacagattggcgtattgctgtattccatcatgatatttatggtagtggatatactcattctcaagattggactatcgcagatccagattatggtatacgatcagtattaacaaaattattaaatgaaaataattttgatcttgctattaatggtcatgatcatgtttatac

SEQ ID NO: 25927 - DNA, 645 bp, Anaeromyces robustus
  Metallophos
taaatttatttttgttggtgatccacaaattggtggttctcatagtcatgtagctcatggtatgagaagagttcttggtcttgatgatggtattagaaatgatgcctttaattggaaaagaactatttctaaagcctttgatcttactaaagaaccaagtcttgtattatctgctggtgatcaagctgattcaccctatgatttattatatagagaaattgaatattctgctcttttccttccagatcaattaaaaactgttccaatggctgctgctgttggtaatcatgatgctgaaagttttagtcatgatcttcattttaatgttccacatccatatcttactccagaatttcaaagtaaaattccaggatataattatttctttaaatttaataatgttcttgttgtagttctcgaaacaaactttattaccgaaaatgatgcagaagtagttatcaataatgctgttgaaacttatccagaaacagaatggcgtattgctttattccatcatgatatgtttggtaatggatatgctcattctcaatttgatgataccactcgtttacgtaaattcttaactgaattatttactaataataattttgatgttgtcattaatggtcatgatcatctttatac

SEQ ID NO: 25928 - DNA, 726 bp, Anaeromyces robustus
  Metallophos
caaatttatttttgttggtgatccacaaattggtggtagtaataatcatcgtacttttaatgaaaatagttctcatttacttactgtaccagaaggtactagaaatgatgcatttaattggaatatgactatttataattcttttaaattaactcgtgaaccaagtcttttaatgtctgctggtgatcaagctgatagtgaatgttttaatcaaactttggaaaatttatataatcaagaaactcaattttcagcattattacttccagaaatattacaaactatcccatctgcatttactgttggtaaccacgaatcacatacagaaagttttaagtttcattttaatacaccaaatacttatcgtacaacagaatgtgaaagtgattctggattggaaatatgtaataatggtatttatgattatgatggtcctttcttcagtccaggttatagttatttctttaagtttaataatgtattagttgttgtacttgaaactaattttaatacatgtaatgatttaacaactgttatttcaaatgctgttgaaaaatataaagatatagattggcgtatagctatgtttcatcacgatatatatggtaatggtcaatatcattcccaagaaccatatattacagatgtattacgtccctgtttaactgaattatttgataaaaataaatttgatcttgttattaatggtcatgatcatgtatatac

SEQ ID NO: 25929 - DNA, 645 bp, Anaeromyces robustus
  Metallophos
taaatttatattctttggtgatccacaaattggtggttctcatagtcatgtttcacttggtcaaagaagaattcttggtgttgacgatggtattagaaatgatgcttttagttggaatagaacgatttctaaatcttttgaatttactaaagaaccaagtcttatattatctgcaggggatcaagctgatgatgatgtagatgaattatatcaagaaatagaatattctgctttatttcttccagaattattaaaaactgttccattagctactgctgttggtaatcacgattcttatactattaattataggcaacatttccatgttccaaatccatatcttacaccagaatatcaatatactattcctggatatagttatttctttaaatataataatgttcttgttgtagtacttgaaactaattatattacagaaaatgatgcctatgaaataattccaaatgccgttaaaaaatatccagatactgattggcgtattgctttattccatcaagatctttatagtaatggatatacccattctcaacaatatgatgttcttcgtttacgtccatttttaactaaattattttctgaatataattttgatcttgtcattaatggtcatgatcatatttattc

SEQ ID NO: 25930 - DNA, 666 bp, Anaeromyces robustus
  Metallophos
ttttgtatttgttggtgatccacaaattggtggatctcatggacgtatttctgttgctgatattacaaaagctcttagtgttgaacaaggtactagaaatgatgtctttaactggaatatgacagttagtagctttttcaatttagttgatgaaccaagtttacttttatcagctggtgatcaagtagatgtacaatgttctacaaaaaatattgtttatgatgattataaccaagaaactcaatattctggttttcttcttccagaattattaaaaactattccaatggctgctgctcttggtaatcatgatgctacaagtaaaaattataggtatcatttcaaccttccaaatccttatcttactccagaaacaattggttatgaaattactggttataatttcttctttaaatataataatgtacttgttgtagttttagaatctaataattcatcatgtaatgatttcaaaacttctctaaaaaatgctatcaaaaaatatccaaatactgattggcgtattgctttattccatcatgatatttttggtaatggtgcaactcattctcaaggtggttcattagaattacgtccatgtttatcaaaattactttcaagttataaatttgatcttgttattaatggacatgatcatctttacac

SEQ ID NO: 25931 - DNA, 672 bp, Anaeromyces robustus
  Metallophos
taaatttatttttgtaggagatcctcaaattggtgcttctcatgatcgtatttcatttgctaaaaatttacaagatgttttaaccatacctgaaagtaccagaaatgatgcttttaattggaatatgacaatttataaatcttttgaattcattaaagaaccaagtttattattatctgctggtgatcaaatagatatagcatgttcacctaaaacagaagaagatctttatttacaagaaactcaatattctggttttcttcttccagatttattaaaaactattccatctgttattgctgtaggtaatcatgaagcattaactcattcttttaaacatcattttaatccaccaaatccttatacaacccctattgaaccagaattagcaccaggttatagttatttttttaaatataataatattctttttgttatattagaaacaaattatggattttgtgatgattttaaagaagttatgagaagagcttatttaaaatatccaaatacagattggcgtattgctatgtttcatcatgatatttatagtaatggtagtaatcattctcaagaagaatatattgttagattcttaagaccatgtttaacggaattattatctaaatataaatttgatcttgtaattaatggtcatgatcatgcttattc

SEQ ID NO: 25932 - DNA, 669 bp, Anaeromyces robustus
  Metallophos
taaatttatttttgttggtgatccacaaattggtggttctgaaggacatgtaacctatgataatccaacagaacctctttctgaagtggatggtactaaaaatgatgcctttaattggaatatgaccattcataaatccttagaattaactaaagaacctagtcttttattatctgcaggtgatcaagttaatgccttttgtatggaaggatatgataaacaatatgaacttcaagaatatgaatattctgcattacttcttcctgatcccttaaaatctcttccaatggcaaccacggttggtaatcatgaaatttatactaaagcttttaaaaatcattatcatacaccaaattcttatgaaactccacttgaaccagatcttgccccaggttataattatttctttaaatataataatgttttagttattgtattggaaaccaattatgggtattgtgatgattttaaagaagttatgagaagagctcatttaaaatatcccaataccgattggcgtattgttatgttccatcatgatatttatagtaatggtaaattccattcccaagaatcctatattacagatactttaagaccatgtttatcccaattaatgacctattataaaatagatcttgtcattaatggtcatgatcatatttattc

SEQ ID NO: 25933 - DNA, 660 bp, Anaeromyces robustus
  Metallophos
atttatatttgttggtgatccacaaattggtggttctcatgatcgtttatctgttgctgatccttaccatgtattaacacgtgaagaaggtactagaaatgatgcttttaattggaatatgacaatttataaatcctttgaaaaaacaggaaagccaagtgtattattatctgctggggatcaagtggatacggaatgtttttctggtaccactgaagaagattatagtcaagaaattcaatattcggctttccttcttccagatttattaaaaactattccatccgctacaaccgttggtaatcatgaagctttaaataaaaattatagaaatcattataatactccaaattcacatattccattagaacctgaaattgcacctggttatagttatttctttaaatataataatgttttagtggttgttttagaaacgaattatagtttttgtgatgattttaaagccgttttcaaaaaagcttttttaaaatatccaaataccgattggcgtgtggctatgttccatcatgatatttatggtaatggtagtttccattcccaagatgaatatattattaataaattacgtccatgtttaacggaattactttcttactacaaatttgatttagttattaatggtcatgatcatatttt

SEQ ID NO: 25934 - DNA, 645 bp, Anaeromyces robustus
  Metallophos
taaatttattttccttggtgatccacaaattggtggttctcatagtcatgtagctcatggtatgagaagagttcttggtcttgatgatgctattagaaatgatgcctttaattggaaaagaactatttctaaagcttttgaatttactaaagaaccaagtcttatattatctgctggtgatcaagcagatacagaacaagatttattatatagagaaattgaatattctgctcttttccttccagatcaattaaaaactgttcctatggctgctgctgttggtaatcatgatgcttggagttttagtcataaacttcattttaatgtaccaaatccatatcttactccagattatagttactttattccaggttatagttatttctttaaatataataatgcccttgtagtcgttcttgaaacaaattatcttactgaaaatgatgctaatgctgtgatcactaatgctgttaaaacttatccaaatacagattggcgtattgctttattccatcatgatatgtatggtaatggagaagtacattctcaaaataatgatgccacttctttacgtccctatttaacaaaattatttacggaatatcaatttgatgttaccattaatggacatgatcatgtttatac

SEQ ID NO: 25935 - DNA, 684 bp, Piromyces finnis
  Metallophos
taaaatcctttttgttggtgacccacaaattggtggtgctcacgacagaattactgcttcaaataattactctagagttctcacaagagaagaaggtaatagaaatgatgcttttaactggaatgttactgtatataattcatttaattttgctggtcaaccaagtcttttattatctgcaggtgatcaagccgatgaagaatatgccgtaaaaggtaatgaatacgattataatgaagaatcccaatattctgcttttcttcttccaaaattaatgcaaaccattccaactgtacctacaatcggtaatcatgatagttacacagaaaactttaaatatcatttcaacacaccaaataattatgcttctaaaaattatacaaagtattataatggaaatgaaccaggatacaattatttctttaaatataataacattttatttgttgttcttaacaccaacgctccaatttgtgaagagtttaccgaaattattaataaggctatcactaaatatcccgatacagactggcgtattgccatgttccaccaagatctttatggtgatggtagtactcattctcaaaatgatggtatcacaaaagtattacgtccttgccttacaaaattaatttatgataacaaattcgatcttgttcttaacggtcatgatcacgtttatac

SEQ ID NO: 25936 - DNA, 201 bp, Piromyces finnis
  Metallophos
taaagaagttttaagacaagctcatgcaaagtatccaaatacagattggagaattgctatgttccatcataatatctatggcaatggtaaataccattctcaggattatcacattacagatgtattacgtccatgtttaacagaacttctttctaattataaatttgatcttgttattaatggtcatgatcatatttatac

SEQ ID NO: 25937 - DNA, 684 bp, Piromyces finnis
  Metallophos
taaatttatttttgttggtgatccacaaattggtggttcacatgaccgttactccatttctaatttatatgagagagtattaacggtggatgagggtacagccaatgatgcctttaattggaatagaactattacccattcctttgattttgttaaagaaccaagtcttttattatctgctggtgatcaagctgatgaagaaaacaatagtttctatagtgatcaagaacattataatgaagaaacacaatactctgcattacttctccctaaacaaattcaaaccattccaatggctgctgctatcggtaatcatgacagaaatactgaaaatttcagacatcattttaacgtacctaatccatataaaaatccatcctatcttatggatgatggatggattgaaggttacaactattactttaaatacaataatgttttaattgtagttcttaacaccaatcatgaagaatgtgttgattttgaatccgtcattaccaatgccgttgaaaaatatccagacactttatggcgtattgctttattccatcatgatatttatggtaatggtgttactcattccttagaagatggtatgaagaatgttttacgtccatgtttaaccaaattattatccaattttaaatttgatcttgccattagtggacatgatcacgtctatac

SEQ ID NO: 25938 - DNA, 687 bp, Piromyces finnis
  Metallophos
taaatttgtatttgttggtgatcctcaaattggaggttctcacgatcgtttttccatcaccaataattatgaaagggttctcacgttgaatgaaggtaatagaaatgacgcattcaattggaatagaactatttctagatcttttgaatttgcaaataaaccaagtctcctacttagtgctggggatcaagccgatgaagaatgtaaacacttggaagataatgaaaaaggacccatggaacttttgaatgaagaaatgcaatattcagcttttcttcttccagatttattaaaatctgtacctgtcgctgctgcagttggtaatcatgatgctagtaataataattttagaaaacattttaattcaccaaattcctacaccgaccccaaataccaagatttaattccgggatataattatttctttagacatcataatgttcttgtcgttgttctcgaaacgaactacgggtattgtgaagatttttccaatgtaattgaaaaggccataaaaaaatatccagacgttgattggcgtattgcaatgtttcatcatgatatctacggtaatggtgtaacccattcgaaggaaccttacattgtcaatgaattacgtccatgtttaacccaattattttatgaaaataaatttgatcttgtgattaacggacatgatcatgtctatac

SEQ ID NO: 25939 - DNA, 687 bp, Piromyces finnis; identical to SEQ ID NO: 25938
  Metallophos

SEQ ID NO: 25940 - DNA, 678 bp, Piromyces finnis
  Metallophos
tttcattttccttggtgatcctcaaattggcggttctaagaatcgttacagtaaacttcttaaggatagaggggtcaccatcgaagaaggtattagaaatgatgcatttaactggaatagaaccctgaccgaagccgtaaactatgtcaaaactccaagtcttatcttatcagcaggggatcaagcagaatctatggcttacgattctgatgaagaacttattttacaagaaaaagaatatgctgcttttcttactccaaatttaattcaatccattcctactgccgctaccgttggtaatcatgatcaatatacggataattttattcatcattttaatccaccaaatttatacaatcaagatactgttcttcaaaccaccggtacgcgtgtccttcccggttacaactattactttaaatataataatgtacttgttgtggtacttgacaccaacaatcacaattgtaccgatttttctacggttatcgaagaagccattgaaaaacatccaaagacggattggcgaattgccatgttccatcatgatatttacggtaatggtagtactcattcttccgaagatgatattaaactttacttacgtccatgcctaactccattgattgataaggctcattttgatcttgtcattaatggtcatgatcatgtctactc

SEQ ID NO: 25941 - DNA, 678 bp, Piromyces finnis; identical to SEQ ID NO: 25940
  Metallophos

SEQ ID NO: 25942 - DNA, 678 bp, Piromyces finnis; identical to SEQ ID NO: 25940
  Metallophos

SEQ ID NO: 25943 - DNA, 678 bp, Piromyces finnis; identical to SEQ ID NO: 25940
  Metallophos

SEQ ID NO: 25944 - DNA, 189 bp, Neocallimastix californiae
  Mucin
tagtaagactcaaaacagtgctgaaccagaagtaacctctaaggctaaaactaccactactactaccactactaccactgctccaaagactactactactacaactaccaccaccaccactaccaccactaagccagttactaccactactaccaccactactaccagtaaagctactaagactgaagc

SEQ ID NO: 25945 - DNA, 171 bp, Neocallimastix californiae
  Mucin
acaaaaaactactaccacaacaactactacaactattaaaaagacaactacaaccacaaccacaaccacaaccaaaactacaactacaactacaaaaacgacaactactacaacaactacaactacaacgactactagaagtcctcaacctactgttcaatgtgccaaaca

SEQ ID NO: 25946 - DNA, 321 bp, Neocallimastix californiae
  NAD(P)-bd_dom
tggtggtttaggtcatttagctgttcaatttgctagtaaaatgggttatgaagttactgctctttctacttcttataataaaaaagaagaagctactggttttggttgtcataactttgttttattaaaggaagctgctgaaaaagttccaaattatttcgatttaattattaatacttctccatatgatatggattggaaaatgcttttaggtttacttagaccaaatggtaaattatgtttaattggtattccagctgttgatatgaaagttccagttatgccaattattttctctcaaaagactatttgtggttctat

SEQ ID NO: 25947 - DNA, 519 bp, Neocallimastix californiae
  NAD(P)-bd_dom
tacgattttaattaccggtggtcttggtggtgtcggtttcgatatttctcgctacttgatgagacaacccaaccttaaggctcttgtacttactggtcgtagaccagaaacggatgaaaaggtagccggtaagttagccgaacttcgtgccctcaatccaaagattaaaattacctatgttaccgccaatgttggttctgaaaccgagatgaagaaggtcattgacgatattaacgctggaagtccagaagaagctttagttggtgtcttccacacagccggtactaatgatgatggtttaatctttaaccaatcgtatgaacgttttgccaagttaattaatagtaagattgaaggtacactttgtattgctaagcttactaatgatttgaacttgaagttcacaatactcttctcttcgatgaccgccttctttggtaatcgtggtcaaattaactactgtaccgctaatatgtttattaataaggtctgtgactactaccgtaatcatggtcgtaa

SEQ ID NO: 25948 - DNA, 489 bp, Neocallimastix californiae
  NAD(P)-bd_dom
cggtaagccaaaagaaggtgaaactatcttcgttactgctgccgctggtgctgttggtcaagttgtttgccaacttgctaagcttaagggtttaagagttgttgcttgtgcttcctctccagaaaagattggtttcttaaagcaagccattaaggtcgatgaagctttcagttaccgtgacttcccagacaaggaatccttcactgctcaattacgtaaggtttgtccaaacggtatcgatatctactacgataacgttggtggatacattcttgattctgctcttgaacttatgaacattcacggtagagttattatgtgtggtatgatctctcaatacaaccttaccgaaaagtacaagtacactcttagagatattacttccagaagacttactcttcaaggttgtttattcaacgattacttcccacaatgcatgggtgaattcatgcaagatatgattccaaagttacaacaaggtaagctcat

SEQ ID NO: 25949 - DNA, 714 bp, Neocallimastix californiae
  NAD(P)-bd_dom
acgttttgatgaacgtgttgtagtcattaccggtgccggtggtggctttggtcgagcccatgcattcttatttgcttctcgaggtgcaactcttgttttaaacgataatgcaatcatatctaataataatggacaaccaaaatatctagtcgatgatgttgttcgtgaaattactaaagctggttttcatgctattgctaattatgaaccaattggaaatggtgataagatcattgaagctgcaatgaatgcttttggaagagttgatattttaattaataacgctggtgttacttgcaataaacctttcaaagaaatgtctgataaggattgggaatatgttcataatgttaatcttcatggtgcttataaggttactaaagctgtttggccaattatgcaaaaacaaaagtacggtagaattattaatattgtttctgcagcaggtctttatggtagttatggtcaaactaattactcctcagcaaaaatggctttacatggctttactttatctttagctagagaaggttatagatacaatatttactgtaattgtgtttcaccatatgttgctttaaattatgatgcctctattaaggataaatctgttcaagttgtaaagccagaatttttatcaccactcttagttttccttactcatgaaaagactcgagaaaatggttctcactttgaagcgggtgctggttatat

SEQ ID NO: 25950 - DNA, 795 bp, Neocallimastix californiae
  NAD(P)-bd_dom
atctaataatgaatctgttggtgatttatccttcaagggtaaggttgttattattactggtgctggtggtggtctaggtcgtgcttacgctaaacattttgctaaattaggtgcttctgttgttgttaatgatttaggtgtccttttacgtggtagaggtgctaacactcaagttgctgatagtgttgttgaagaaattaagcaaatgggtggtattgctgttccgtcttatgattctgttgaagaaggtgaaaagattgttgaaaccgctattaagaactttggtcgtgttgatattattattaataatgctggtattttaagagatagatcttttggtagaatgactgatactgattggatgatgacatatagagttcacttaaagggtacttataaggttacaagagctgcttggccatacatgatgaaacaaaagtatggtagaattattaatattacttctgcggctggtctttttggtaactttggtcaatctaattatgctgctgctaaatctggtgttattggtctcactaatgcattagctttagaaggtaaagagtataatattactgtaaatagtgttgctccaaatgctggtactagaatgacagctactattatgccacaagaaatggttgaattacttaaaccagaatatactgctccacttattagtttccttactcatgaatcttgtaatgctactggtggtatctatgaagtaggtagttgttgggttgctcgtttacgttggcaacgtagtggtggtgcttcttttgctatcaataa

SEQ ID NO: 25951 - DNA, 714 bp, Neocallimastix californiae
  NAD(P)-bd_dom
acgttttgatgaacgtgtagtagtcattaccggtgccggtggtggctttggtcgggcccatgccttcttatttgcttctcgaggtgctactcttgttttaaacgataatgccatcatttctaatagtaatggtcaaaaaaaatatttagttgatgatgttgttcatgaaattactaaggctggtttccatgccattgctaattatgaaccaattggaaatggtgataagattattgaagctgctatgaatgctttcggaagagttgatattttaattaataacgctggtgttacttgcaataaaccattcaaagaaatgtctgataaggattgggaatatgttcataatgttaatcttcatggtgcttacaaggttaccaaggctgtctggccgattatgcaaaaacaaaagtatggtagaattattaatattgtttctgcagctggtctttatggtagttatggtcaaagtaactactcttcagctaaaatggccttacatggttttactttatccttagctagagaaggttatagatataatatttattgtaactgtgtttcaccatacgttgccttaaattacgacgcttctattaaggataaatcagttcaagttgttaaaccagaatttttatcaccactcttagttttccttactcatgaaaaaaccagagaaaacggttctcatttcgaagctggtgctggttacat

SEQ ID NO: 25952 - DNA, 783 bp, Neocallimastix californiae
  NAD(P)-bd_dom
tattggtgatttatccttcaagggaagagtagttattgttactggtgctggtggtggtcttggtcgtgcctatgctaagcactttgctaaattaggtgcctcagtcgttgttaatgatttaggtgtccttttacgtggtagaggtgctaacacacaagttgctgatggtgttgttgaagaaattaaaaagatgggtggtattgctgttccatcctatgattctgttgaagaaggtgaaaaaattgttgaaactgctataaagaactttggtcgtgttgatattattattaataatgctggtattttaagagatagatcttttgcaagaatgactgatactgattggatgatgacatacagagttcatttaaaaggtacctataaagttactagagctgcttggccatatatgatgaagcaaaagtatggtagaattattaatattacctctgctgccggtcttttcggtaactttggtcaatctaactatgctgctgctaaatctggtgtcatcggtctcactaatgccctagctttagaaggtaaagaacataatattactataaatagtgttgctccaaatgctggtactagaatgacagctaccattatgccacaagaaatggttgaattacttaaaccagaatacactgctccacttattagtttccttactcatgaatcttgtaatgttactggtggtatctacgaagtcggtagttgttgggttgctcgtttacgttggcaacgtagtggtggtgcttctttcgctatcaataaatt

SEQ ID NO: 25953 - DNA, 525 bp, Neocallimastix californiae
  NAD(P)-bd_dom
taatcctccaacagcttatagaatgttaaaggactttgttaacttaaaaaaaggtgatgttgttattcaaaacggagctaatagtgcagttggtcaatctgttattcaaattgctaaagcttggggtattaaaactattaatgtcatacgtgacagaccaaattttgaagaagttgctggagaattacataaacttggtgctacattagttattaaagaagaggatttacgttctaattctactcgcgaacttgttaagaacttaggtagtccagttcgtttagctttaaattgtgtcggaggaaagtcagcttctggaattacacgtttacttggccaaaatgctactattgttacctatggaggtatgtctaagcaaccacttactttcggtactggtccatttatttttaagaatttacgtgcaagtggtttttggatttctcgttggaacaaagaagcttcaaagaaagataagcaatatatgtttgatgatatttgtgaacttgttcgaggtggtcattt

SEQ ID NO: 25954 - DNA, 642 bp, Neocallimastix californiae
  NAD(P)-bd_dom
tattcttattactggtggtttaggtgatgtaagtatggatgtcgttaattctctcctagctgacaaggacagtaaattggaacacattttccttctcggtagatccagtaagactaacagtagagttattgaaaagttagctcgtattgaaaaggtaaggaaagatcatgataaaaatattcaaattgaatattattcttgtgatatttctgatgaatcctctcttgctgaagtattcaatgatattcgtaaacgtcaaggcttacaaattactggtattttccatactgctggtgtcaacagtgatgccaacttcttaagccaatcctatgaaaaattagttgaaattgctccttcaaagattattggtactcataatattatgaaactttctgaagaatttaaggatgaacttaagtttgttgtctttgtttcatccctttctgctgttagtggtaacggtggtcaaactaactatactgctgctaatatgttcattgatgcgcttgctagatattataatgaccacggaagaactaatgtcatcgccatcgaactcggtggttggaagggagctggtagtagtgatcaattagttaatgattttatggtcattacttcagaagctggttttaatatgtt

SEQ ID NO: 25955 - DNA, 327 bp, Neocallimastix californiae
  NAD(P)-bd_dom
tatgggtttaggtggtttaggtcaccttggtgtacaatttgctcatgctatgggagctgaagttaccgttcttggtcattcagaatccaaaaaagaggaagccaagaaacttggagccgattgttatgaaattttaaagactgatgaagatttcaaaaaatattacagaacctttgattttattttaaattgtgctactgctaatcttaatttagataaccattttaaattattaaaaccaaatggtgtcctatgttttgttagtattgtaccagaggaacaaaggtttagtgaattaaatctttttggtaatcaagcttccataac

SEQ ID NO: 25956 - DNA, 588 bp, Neocallimastix californiae
  NAD(P)-bd_dom
ctatttaattactggtgcttttggtggtgtcggtttaagagttgttctttggctagttagccgtggtgccaagaacattttattaaccactagtagttctgttgaaaaacaatatgaacaaccaattattagatctttattggaaaagggtattaatgtaatgattaagacctgtgatattactgatttgactagtgttcaacaattattccaacaaactactccaagaattgctggtgtcttccatttagcaaatcgctttgctccaggtttaattagtacttccgatcttgctttgcttcgtaagggcttcagtgctaaggctgaaggtgcatggaatttacacttggttactcttcaaaaggctcatcaagttcaattgtttgttgtcttttcttccattcttgatgttttaggtaatcgtggtcaaactgcttatggtgctgctaatgctttcttaagttctattgttgatcatcgtagagaaaaaggtctctctggtaattgtattgctcttccagctatgcgtggttctggttacttagcaaaatggaatcaaacaaaacaatctaaggactttgaacaatt

SEQ ID NO: 25957 - DNA, 291 bp, Neocallimastix californiae
  NAD(P)-bd_dom
cgccgctgctggaggtgtaggtcaagctgccgtgaagttatgtcaactctggggtgctaatattattgccagtgcttctgcttcgaagcaacaattccttcgtgatacttatggtcttgagcatgtaaccaactccagagatccagaagaattctaccgtgatgtgatgaagtggactgatggtaagggcgttgactttgtgttaaactctctttccggaaagagtcttaaaatgggtattaagtgtttgaagaatggtggtaagtttgttgaaattggaaagactgatat

SEQ ID NO: 25958 - DNA, 723 bp, Neocallimastix californiae
  NAD(P)-bd_dom
ctttactggtaagcatgttcttatcactggttgtggtagaaactcaattggtgaatgtgttcttaagtacctcttagctggtggtgctaaggttgttgctactacctctagctaccgtcgtgctaccatggaacactttagaagtgtatatgaacaagttggtactaagggttccactttagttgttgttccattcaaccaaggttctaagaaggatgtcaatgatctcattgaattcatctactctaaggatagtcgtgtcaacggtctcggttgggatcttgacttggttattccattcgctgctatctctgaaaatggtcgtgatattagtgacttggatggtaagagtgaattagctcaccgtattatgatgaccaatgttattcgtattcttggtgctgttcgtactcaaaagatgaaggttggttcacttgtctctgctcaagttatccttccattatctcctaaccacggtacttttggtggtgatggtttatacggtgaatctaagattggtttggagaacctcttaaaccgttggagatctgaaacctggtctaagtacctttctatcactggtgcctgcatcggttggacgagaggtaccggtttaatgaacagtaacaaccttatctctgaaggtattgaaagccaaggtacctgccgtactttcactaccactgaaatggccttcaacttgattggtcttgtttctgatgt

SEQ ID NO: 25959 - DNA, 285 bp, Neocallimastix californiae
  NAD(P)-bd_dom
agctggtggtgttggtcaagcagctattaaattatgccaatattggggtgcaaagatatttgttagtacttcagctaaaaaagtccaatacttgaaggatatgtatggtttagaatacattactaattccagagattcgaagactttttataacgatattatgaaatggacaaataatgaaggtgttgactttgttttgaatgccctcgctggtgatggtattacatatggacttaagtgcttaaagaagggtggtcattttgttgaaattggaaagaagaatat

SEQ ID NO: 25960 - DNA, 546 bp, Neocallimastix californiae
  NAD(P)-bd_dom
aaataaagcatatttaatcactggagctttcggtggtgttggtttacgtgttgctgaatggcttcagttaagaggtgccaagaatattgttttaactacatctggtaatatagaaaagcgtaacagaaaccctattgtggaaactcttcgtagtaaaggtgtccatgtgacagttacccaatgtgacatttcaaatattcatgctgtccgtaagttattccaagaaacaacaccacaaattgctggtattttccatctagctaataaatttgctcctggattgattcaaagaacttcccttgaacaattccatgttgcttataatccaaaagcaagaggtgccttaaaccttcatttagttagtaaagattatccaatagatatgtttgttatgttttcttctgttcttgatcttttaggtaataagggccaagctgcttatggcgcagctaattccttccttggttccttagttgaacttcgtcgttcgcaaggtttatgtggttcatgcctttccttgccagcgatgaagggttccggttacct

SEQ ID NO: 25961 - DNA, 627 bp, Neocallimastix californiae
  NAD(P)-bd_dom
ctttaagaacaagtatgttttaatcactggttgtggtcgtaactccattggttcccaaattattaagggattattaaatggtggtgctaagattattgctactacttccagattcagtaaggcaaccatgcaatactaccgtcaactctatgaagatcatggttctaagggatcttgcttaattgttgttccattcaatgccgcttctgttgaagatgttaatcgcttaatcgattacatttactctaaggatccaaagaatggtttaggatgggatcttgattacgttattccattcgctgccatctccgaaaatggtagaactttagaaaacattgacagtagaagtgaattagctcatagaattatgcttactaacttattaagaatgttaggtaagattgttagccagaaggaggctcacaagtatgatactcgtccagctcaatgtattcttccaatgtctccaaaccatggtaccttcggtggtgatggtctctactctgaatccaagattgctcttgaaaccctcttcaaccgttggcattcagaaggatggggaggttaccttaccgttgctggtgccgtcattggttggaccagaggtactggtttaatgaatagtaa

SEQ ID NO: 25962 - DNA, 498 bp, Neocallimastix californiae
  NAD(P)-bd_dom
agataaatcctatttagttacaggagcctttggtggtgttggtttaagagtttgtctttggatgcaacttcgtggagctcatcatcttgtattgaccacttcttctaatcctgaaagtaaaaaggatcatccgatagtgaaggccttacgtcaacgtggcgcgcaagtctcgattgttaaatgtgatatatccaagtatgatgaagtagaaaagctctttaaggaaaccagtccatccctggatggagttttccactttgctaataaatttggaccaaaacttattcgtgattctggtcttgaaagctttattgccacctatgaacctaaagctcgtggagctcttaatcttcataagattagtcaaaagggttatcctctctccacctttgtcctcttttcctctgtcctcgatcttctcggtaataccggtcaaattgcctatggtggagccaatgccttcctcggtaatcttgtatattaccgtagaagacaagg

SEQ ID NO: 25963 - DNA, 291 bp, Neocallimastix californiae
  NAD(P)-bd_dom
cggagatcgtaatcaatgcgttcaacaggtcaaggccttcaccaataatcagggggttcactatgttattgatgccaatgtaaaatttgatcatgaagaggtattggaagcctgcttaagggaaggaggtgaatacattaaggtaggtaatcttgatcatcatgttaagaagagaacgacacataaggttgttcaaatgagtgccctcagtgtcaaacaaatggcacctttagtaagagaagccattgaaaaaattaataaatgcaccgtagaagctattgaacttaaatc

SEQ ID NO: 25964 - DNA, 330 bp, Neocallimastix californiae
  NAD(P)-bd_dom
tatgggcttaggtggtttaggccatcttggtgtacaatttgctcatgctatgggtgctgaagttaccgttcttggtcattcagaatccaaaaaagaggaagccaagaaacttggagccgattgttatgaaattttaaagactgatgaagatttcaaaaaatattacagaacttttgattttattttaaattgtgctactgctaatcttagtttagataaccatattaaattattaaaaccaaatggtgtcttatgttttgttagtattgtaccagaggaacaaaagtttactgaaatgaatctttttggtaatcaagctaccataacagt

SEQ ID NO: 25965 - DNA, 624 bp, Neocallimastix californiae
  NAD(P)-bd_dom
taaaaataagtatgttttaattactggttgtggtcgtaattccattggttctcaagtgattaagggattattaaatggtggtgctaagattattgctactacttctagattcagtaaggctactatgcaatactaccgtcaactctatgaagatcatggttctaagggatcatgtttaattgttgttccattcaatgctgcttctgttgaagatgttaatcgtttaatcgaatacatttactccaaggatccaaagaatggtttaggatgggatcttgattatgttattccattcgctgctatctccgaaaacggtagaactttagaaaacattgatagtagaagtgaattagctcatagaattatgctcaccaatttattaagaatgttaggtaagattgttactgaaaaggaatcgcataagtatgatacacgtcccgctcaatgtattcttccaatgtcaccaaaccatggtacctttggtggtgatggtctctactctgaatccaagattgctcttgaaaccctcttcaaccgttggcattcagaaggatggggaggttatcttactgttgctggtgctgtcattggttggactagaggaaccggtttaatgaatagtaa

SEQ ID NO: 25966 - DNA, 528 bp, Neocallimastix californiae
  NAD(P)-bd_dom
cggtaccgtcttaattactggtggtactggtggtgttggtttcgatatctgtcgctacctcgttaaacaagctaaccttaagggtcttgtccttactggacgtcgaccagaaaccgatgaaaaggttgctggtaggttagccgaaattcgtgcccttaatccaaagattaagattacctatgtcaccgctaatgttggttctgaacaagaaatgaagaaggtctttgatgatattaactctggctctccagaagaagcccttgttggtgttatccatactgctggtaccaacgatgatggtttaatcttcaaccaatcctatgaacgtttcgcaaagttaattaacagtaagattgaaggtgctctctgcattgctaagcttacggaaggtttgaacttaaagttcaccattctcttctcctccatgacggccttcttcggtaaccgtggtcaaattaactactgtacggctaacatgttccttaacaaggtttgtcagttctaccgttcccacaacggtcgcaagga

SEQ ID NO: 25967 - DNA, 486 bp, Neocallimastix californiae
  NAD(P)-bd_dom
ggaggataaatcttatttggtgaccggggcttttggtggtgttggtttaagagtttgtctttggatgcaacttcgtggagctcatcatctcgtccttactacctcctctaatcctgaaatgaagtatcatcatccaattgtgaatgccttacgtcagcgtggtgctgaagttaccattgtgaaatgtgatatttcaaagtataatgaggtggaaaaactttttaaggaaactactccagtgattgatggtgtcttccattttgctaataaattcggaccaaaattaattcgagattccaacctttcaggttttatctccacctatgagcccaaggcacgtggagcgctcaatcttcataaagttagtcaacagggttatcctctctccaacttcgttctcttctcttctgtattagatcttcttggaaataccggtcaaattgcttatggtggtgccaattctttccttggtaatcttgtctatta

SEQ ID NO: 25968 - DNA, 312 bp, Neocallimastix californiae
  NAD(P)-bd_dom
aagaatagtaaattctggagatcatgaccaatgtcttcatcatgttaaacagttaactaatggtcatggagtccactatgtcatcgacgccaatgtcaaatcggacagagaaaatgttttgaaggaatgtctaagccataaaggtgaatatattagggttggtcattttagtcaaaatgttattaaaaagagtatatccaatagagtcattcaaatgaatgctcttagtaccaaggaaatctcaccaatagtaagaaaggctatagaaatgattaatgactattctgtggaagccattgagctcaaaaccta

SEQ ID NO: 25969 - DNA, 492 bp, Anaeromyces robustus
  NAD(P)-bd_dom
ttttgttaatttaaaaaaaggtgatgttgttattcaaaatggtgctaatagtgctgttggtcaatctgttatacaaattgctaaagcttggggtattaaaaccatcaatgttgttcgtgacagaccaaattttgatgaacttgcctctgaattacataaacttggtgctacattagttattaaagaagaagacttacgtgctaattctactcgtgaactcgttaaaagtttaggaagtccagttcgtttagctttaaattgtgttggtggtaaatctgcttctggtatcactcgtttacttggtcataacgctactatcgttacatatggtggtatgtctaagcaaccacttacttttggtactggtccatttattttcaagaatttacgtgcttgtggctactggaattctcgttggaataaagaagcttcaaagaaagataaacaatatatgtttgatgatatctgtgaacttattcgtggtggacattt

SEQ ID NO: 25970 - DNA, 714 bp, Anaeromyces robustus
  NAD(P)-bd_dom
acgttttgacgaacgtgtagtcgtcattaccggtgccggtggtggttttggtcgagcccatgcttttttatttgcttctagaggggctactcttgttttaaacgataatgctgtcgtttcacataagaaaggtcaaacaaaatatgtcgttgatgatgtcgtcaatgaaattacaaaggctggtttccatgccattgctaactatgaaccaattggaaatggtgataagatcattgaagctgctatgaatgctttcggaagggttgatattttaattaataatgctggtgttacttgtaataaacctttcaaagatatgactgataaagattgggaatatgtacataatgtcaatcttcatggtgcctataaggttactaaggcagtttggccaattatgcaaaaacaaaaatatggtagaattattaatattgtttctgctgctggtctttatggtagttatggacaagttaattattcttcagctaagatggctttacatggtttcacattatcattagctagagaaggttatagatacaatatttattgtaactgtgtttcaccatatgttgcattaaattatgatgctacaattaaggataagtcagttcaagttgttaaaccagaatttttatctccacttttagttttccttactcatgaaaaaactagagaaaatggttctcactttgaagctggtgctggttacat

SEQ ID NO: 25971 - DNA, 780 bp, Anaeromyces robustus
  NAD(P)-bd_dom
tgttggtgatttaaactttaagggtagagttgttattgtaactggtgctggtggtggtcttggtcgtgcttacgctaagcatttcgccaaattaggtgcttctgtcgttgttaacgatttaggtgtccttttacgtggtagaggtgctaacactcaagttgctgatagtgttgttgaagaaattaagaaaatgggtggtattgctgtcccaagttatgattctgttgaagaaggtgaaaagattgttgaaactgctattaaaaactttggccgtgttgatgtcattataaataatgctggtattttaagagatagatcatttgctagaattactgatactgattggatgatgacttataaagttcacttaaagggtacctataaagttactaaggctgcttggccatatatgataaaacaaaaatacggtagaattattaatattacttctgctgctggtctttttggtaactttggtcaatctaattatgctgcagctaaatctggtgttattggttttaccaatgctttagcattagaaggtaaggaacacaatattactattaacagtgttgctccaaatgctggtactagaatgacagcaactattatgccacaagaaatggttgaattacttaaaccagaatatactgctccattaattagtttccttactcatgaatcttgtactgctactggtggtatttatgaagttggtagttgttgggttgctcgtttacgttggcaacgtagtggtggtgcttctttcgccattaataa

SEQ ID NO: 25972 - DNA, 525 bp, Anaeromyces robustus
  NAD(P)-bd_dom
aaacccaccaactgcttatagaatgttaaaagattttgttaatttaaagaaaggtgatgttgttatacaaaatggtgctaatagtgctgttggacaatctgttattcaaatcgccaaggcctggggtatcaaaacaattaatgttgtccgtgatagaccaaactttgatgaatttgctgccgaattacataagcttggtgcaactttagttattaaagaagaagatttacgtgctaattctactcgagaacttgtaaaaaacttaggtaatccagttcgtttagccttaaactgtgttggtggtaaatctgcttctggtataacccgtttacttggtaataacgctacaattgttacctatggtggtatgtctaaacaaccacttactttcggaactggtccatttatcttcaaaaatttacgtgcttgtggtttctgggtttctcgttggaataaagaagcttcaaaaaaagataaacaatatatgtttgatgatatttgtgaacttattcgtggtggtcattt

SEQ ID NO: 25973 - DNA, 630 bp, Anaeromyces robustus
  NAD(P)-bd_dom
ctttgctggtaaacatgttcttattactggttgtggtagaaattctattggtgaaaatgttttgaaatatcttattgctggtggtgctaaggttgttgctactacttcaagttatcgtcgtcaaactttagaacactttagaagtgtttatgaacaagtaggtactaagggctctactttagtcgttgtaccatttaatcaaggatctaagaaggatgttaatgatcttatagaatttatttattccaaggatagtcgtgttaatggtcttggatgggatcttgatttagttattccgtttgctgccatttctgaaaatggacgtgatattagtgatttagatggtaagagtgaattagctcatcgtattatgatgactaatgttattcgtattcttggtgctattcgtaatcaaaagatgaaggttcgttcccttgtttcctgtcaagttgttcttccactttcaccaaatcatggtacttttggaggagatggtttatacggagagtccaagattggattagaaaacttattaaaccgttggagatctgaaacttggtcaaactatttatctattactggtgcttgtattggttggaccagaggtactggtttaatgaatagtaataa

SEQ ID NO: 25974 - DNA, 489 bp, Anaeromyces robustus
  NAD(P)-bd_dom
cggtaagccaaaagaaggtgaaaccatctttattactgctgctactggtgctgttggtcaagttgtttgtcaacttgctaaacttaagggtttaagagttgttgcttgtgcttcatctccagaaaagattggtttcttaaaacaagctcttaaggttgatgaagcttttagttaccgtgacttcccagacaagaaatcttttactgaacaattacgtaaggtttgtccaaatggtattgatatctattacgataatgttggtggatacattcttgattctgctcttgaagttatgaacattcatggtagagttattatgtgtggtatgatctctcaatacaaccttaaggacaaataccaatacactcttagagatattacttccagaagacttactcttcaaggttgtttattcaatgatttcttcccacaatgtatgggtgaatttatgcaagatatgattccaaagttagaaaagggacaaattat

SEQ ID NO: 25975 - DNA, 570 bp, Anaeromyces robustus
  NAD(P)-bd_dom
acttattaccggtggtttaggtgatattagtattgatatcatgaaatatttcttttctttagatcattgtaaattagatcatattttccttattggtagaagtagtaaatctagtgccaaggtcaatgataagttagctcgtcttgataaatctatgaaggataatggtaaaaatattgatattcaatactatccatgtgatatctctaatgaagctgcacttgctgaagttttcaatgatattcgtaaacgtcaaggtttacaaattaatggtattttacatactgctggtactaatagtgatgcctctttcattaatcaaacttatgataaattagttgaaattgctccagctaaaattcatggtactcataatatcattaaacttactgaagaatttaatgatgaaataaagtatattgttttattttcttccattactgctctttctggtttctcaggtcaaaccaattatactgctgttaatttattcattgataatattgctaaatattgtaaaaaccatggtagagacaatgttatgtctattgagttaactatttgggaaaa

SEQ ID NO: 25976 - DNA, 540 bp, Anaeromyces robustus
  NAD(P)-bd_dom
tactattttaattactggtggtctcggtggtgttggttatgatgtttctaaatatcttattaccaaaccaaatcttaaagctcttgttcttactggtcgtagaccagaaacagatgaaaaggttgctgctaagttaaatgatcttcgttctgctagtaaaaatgttaaaattatttatgccgttgctaatgttaattctgaagaagaaatgaaaaaattatttgatgatattgctgcttcagaaaatccattaactggtataattcatactgctggtactaatgatgatggtttaatctttaatcaatcctatgaacgttttatgaaattagttcctggtaaggtagaaggtccacttattattactaaacttactaaggatataccaaatttaaaattcactattcttttatcttctatgagtagtttctttggtaatcgtggtcaaattaattataccactagtaatgtatttattaataaactttgtcgttactaccgtgctcatggtagaaaggatatggttgctttacaattagc

SEQ ID NO: 25977 - DNA, 624 bp, Anaeromyces robustus
  NAD(P)-bd_dom
taaaaataagtatgttttaattactggttgtggtcgtaactctattggttctcaagttattaagggattattaaatggtggtgctaagattattgctactacatctagatttagtaaggctactatgcaatactaccgtcaactttatgaagatcatggttctaaaggttcatgtttaattgttgttccatttaatgctgcttcagttgaagatgttaatcatctcattgaatatatttattctaaggatccaaagaatggtttaggttgggatcttgattatgttattccatttgctgctatttctgaaaatggtagaactttagaaaacattgatagtagaagtgaattagctcatagaattatgcttactaacttattaagaatgttaggtaagattgtttctgaaaaagaagctcataagtatgatactcgtccagctcaatgtattttaccaatgtctccaaatcatggtacattcggtggtgatggtctttactctgaatcaaagattgctcttgaaacacttttcaaccgttggcattcagaaggatggggaggttatcttaccattgctggtgccgttattggttggacaagaggtactggtttaatgaatagtaa

SEQ ID NO: 25978 - DNA, 486 bp, Anaeromyces robustus
  NAD(P)-bd_dom
taaatcttatttaattactggtgcttttggtggtgttggtttacgtgttgctttatggcttcaattaagaggagctaaaaatattattttaacaacttcaggtaatgctgaaaaacgtaataaaaatccaattgttgaaggtcttcgtaataaaggtgttaatgttttagtacgtcaatgtgatatttctgatattaatgctgtacgtaaattattccaagaagctaatccaccaattgctggtatattccatcttgctaataagtttgctccaggtttaattgaaagaacttccttagaacaattccatgttgcttacaatccaaaggcaagaggtgccttaaatcttcatttagttagtaagaattatccagttgatatgtttgttatgttctcatctgtacttgatcttttaggtaataagggtcaagctgcttatggtgctgctaattccttccttggttctttagttgaacttcgtcgttc

SEQ ID NO: 25979 - DNA, 285 bp, Anaeromyces robustus
  NAD(P)-bd_dom
tgctggtggtgtaggtcaagctgctataaaattatgtaaatactggggtgctaaaatttatgttagtacttcaacaaaaaagagagaatatttaaagaatttatatggattggagtatattactgattcaagaaatccaaagattttctatgaagatattatgaaatggactaataatgaaggtgttgactttgtccttaatgctcttgcaggtgatggtattacctatggtttaaaatgtttaaaaaaaggtggatgttttgttgaaattggtaaaaagaatat

SEQ ID NO: 25980 - DNA, 489 bp, Piromyces finnis
  NAD(P)-bd_dom
tggtaagccaaaagaaggtgaaaccatttttgttagtgctgcttctggtgccgttggtcaagttgtttgtcaacttgctaagcttaagggtttaaaggttgttgcttgtgcttcttctccagaaaaaattggtttcttaaagggtgctattaaggttgatgaagctttcagttaccgtgacttcccagacaaggaatccttcgttgctcaattacgtaaggtttgtccaaacggtattgatatctactttgataatgttggtggatacattcttgattctgctcttcaacttatgaatgttcatggtagagttgttatgtgtggtatgatctctcaatacaaccttaaggacaagtaccaatacacccttcaagatatctctaacagaagacttactcttcaaggttgcttattcaacgattacttcccaagatgcatgggtgaatttatgcaagatatgattccaatggttcaatccggtaaacttat

SEQ ID NO: 25981 - DNA, 573 bp, Piromyces finnis
  NAD(P)-bd_dom
tactattttaattactggtggtcttggtggtgttggttacgatatctctcgtttccttatgaaacaaccaaaccttaagggtcttgttcttactggtcgtagaccagaaactgatgaaaaggttgctgctaaattatcctccattcgtgaagttaataaggctattaaggttacctatattactgttaatgttggttctcaaactgaaatgaaagaggttattagtggtattaaggctagtggtagtaaattaactggtattattcacactgctggtgttaatgatgatggtttaattttcaaccaatcctatgaacgtttcgccaaattaattaacagtaagattgaaggttctcactgtatcgctaagattactgaaggtatgaacttggaatttattcttctcttttcttctatgacttccttctttggtaatcgtggtcaaattaactattgtgttgccaatatgtttgttaataaaattgctcactactaccgtagtcacggaagaaaggatattatcactttacaattagctgtatggccatccggtcttacctcaaagattttaga

SEQ ID NO: 25982 - DNA, 489 bp, Piromyces finnis
  NAD(P)-bd_dom
cttcgttaacttaaagaaaggtgatgttattattcaaaatggtgctaatagtgctgttggtcaagctgttattcaaattgctaaagcatggggaattaagactattaatgttgttcgtgacagaccaaactttgatgaacttgctgatcaattacataagcttggtgccactttagtcattaaagaagaagacttacgtgctaacagtactcgtgaacttgttaagaatttaggaagtccagttcgtttaggtttaaactgtgttggtggtaaatcagccaatggaattacacgtttacttggacataatgcttctcttgttacttacggtggtatgtccaagcaaccacttacttttggtactggaccatttatttttaaaaacttaaaagcctgtggtttctggaactctcgctggaataaggaagcttcaaagaaggataagcaatatatgtttgatgatctttgtgaacttattcgtggaggtta

SEQ ID NO: 25983 - DNA, 285 bp, Piromyces finnis
  NAD(P)-bd_dom
agctggtggtgttggtcaagctgctattaaattatgtcaatactggggtgctaaggtatatgtcagtacttctgctcgtaagagaaaatacttggaggacttgtatggattagaacacattacagattccagaaatccaaagactttctatgaagatattatgaagtggaccaacaacgaaggtgtggactttgtcttaaatgctcttgctggtgatggtattacctatggtcttaagtgcttaaagaaaggaggtcgtttcattgaaattggaaagaaaaacat

SEQ ID NO: 25984 - DNA, 483 bp, Piromyces finnis
  NAD(P)-bd_dom
ggataaatcatacatcattactggtgcttttggtggtgttggtttacgtgttgccttatggcttcaattaagaggtgccaaaaacattgttttaactacctctggaaatgctgccaaacgtaataagaacccaattgttgaaggtcttcgtagtaagggtgttaacgttaccgtttgtcaatgtgacatttcaaatattaatgctgttcgtaaattattccaagaaactactccacaagttggtggtattttccatcttgctaacaaattcttaccaggtttaattccaagaacttcattagaacaattccatattgcttacgatccaaaggctaaaggtgctttaaatcttcatcttgttagtaaggattacccaatagatatgtttgtcttattctcttctgtccttgatttattaggtaataagggtcaagctgcttatggtgctgctaattccttccttggttctttagttgaattccg

SEQ ID NO: 25985 - DNA, 534 bp, Piromyces finnis
  NAD(P)-bd_dom
tttaatcacaggtggtttaggtgatgttagtatggatgttattgaaaatttgttatctgataaggaaactaaacttgaccacatcttccttttgggtagatctagtaaaactagtactaaggttgaagataaattagatcgtattgaaaaaattaaaaaggccaataataagaaaactgaagttgaatactattgttgtgatatttccaatggagattcattaaatgacgtattcaatgatatccgtaagcgtcaaggtttacaaattaatggtatcttccataccgctggtactaatgatgatactttattcttaactcaaacttacgaaaagtttgaaaaattagctccagctaaggttattggtactcataatattattaagtacacagaagattttaaggatgaattaaagtttatcattttaacttcttctcttactgccctttctggtttaactggtcaaaccaattatactgctgctaacatgtttattgatgccattgctagatattgtagaaaccatggaagaaa

SEQ ID NO: 25986 - DNA, 498 bp, Piromyces finnis
  NAD(P)-bd_dom
ggaaaataaatcctatttgattaccggtgcttttggtggtattggcttaaaagttggtctttggatgcaacttcgtggtgctcgtcatattgtattaacaacatcgtctgatccagagagtaaatataagcatccaattgttaatgctttacgtcaaaaaggtgttcatgtcaccattactaaatgtgatatttcaaagtatgatgaagttgaaaagcttttcatggaaaccacaccagcaatcgatggtgttttccatttcgctaataaattcggtccaaagcttatcagggattctagcctagatagttttaatacagcatttgaaccaaaagcaagaggtgcattaaatcttcataaaataagtcaaaaaggattctcactttcttcctttgttcttttctcctctgttttagatattcttggtaattctggtcaaatggcatatggtgctgcaaattcttaccttaataatcttatttattatagaagacgtaa

SEQ ID NO: 25987 - DNA, 468 bp, Piromyces finnis
  NAD(P)-bd_dom
aattccaacaggtgaatctgtccttatttcaacggatgcaagtgatttaatgcaagctttagctaccattgctcaacagaaaggtattaacctctttatcgatgatacatcttcaaaatacagtaaagctaatagcaatgccttcaagaatattaaagcccaaatgataaatactcgtcaagcatccgaatacgttcgtcttgtcaaacaacatacgaatggtgaaggtgttggtgttattattgacattaatgtaaagtttgataaggaaaacacactagaaaaatgtttaagaattgatggtgaatatatcaaggttggaaatattgatcaaagtaccaagaaaagaactacccataagatagttcaaatgagtcattttaaggataatgtcattactccagtagtccgtcaagcagtggaaatgattattcatggtaaggttgaagccattgatcttaagacata

SEQ ID NO: 25988 - DNA, 624 bp, Piromyces finnis
  NAD(P)-bd_dom
taagaacaaatatgttttagttactggttgtggtcgtaactctattggttctcaaattattaagggattattaaatggtggtgctaaaattattgctaccacttcaagattcagtaaggttactatgcaatattatcgtcaactttatgaagaccatggttctaagggttcatgcttaattgtagttccattcaatgctgcttctactgaagatgttaatagattaattgaatacatttactccaaggatccaaagaatggtttgggttgggatcttgattatgttattccatttgctgctatctctgaaaatggcagaaccttagaaaacattgatagtagaagtgaattagctcacagaattatgcttactaacttattaagaatgttaggtaagattgttagtgaaaaggaagctcacaagtatgacactcgtccagctcaatgtattttaccaatgtctccaaatcatggtacttttggtggtgatggtctttactctgaatccaagattgctcttgaaactctcttcaacagatggcattctgaaggatggggaggttaccttactatcgtcggtgctgtaattggttggactagaggtacaggtttaatgaacagcaa

SEQ ID NO: 25989 - DNA, 624 bp, Piromyces finnis; identical to SEQ ID NO: 25988
  NAD(P)-bd_dom

SEQ ID NO: 25990 - DNA, 624 bp, Piromyces finnis; identical to SEQ ID NO: 25988
  NAD(P)-bd_dom

SEQ ID NO: 25991 - DNA, 624 bp, Piromyces finnis; identical to SEQ ID NO: 25988
  NAD(P)-bd_dom

SEQ ID NO: 25992 - DNA, 291 bp, Piromyces finnis
  NAD(P)-bd_dom
tgctgctgctggaggtgttggtcaagctgctgttaagttatgtcaactctggggtgctaacattattgcctcagcatcagcttctaaacaacaattccttcgtgacacctatggtattgaacatgtcaccaactctcgtgatccagaacaattctacagtgatgttatgaaatggaccaatggtaagggtgttgactttgtcttaaactctctctctggaaagagtctccgtatgggtattaaatgcttaaagaacggtggtaagtttgttgaaattggaaaaactgatat

SEQ ID NO: 25993 - DNA, 597 bp, Piromyces finnis
  NAD(P)-bd_dom
ctatcttgttactggtgcctttggtggtgttggtttaagagttgttctttggttagttagccgtggtgcaaagaaccttttattaactactagtggatcagttgaaaagcaatatgaacaaccaattattcgttctttaattgaaaagggagtcaatgttatgattaagacctgtgatatcactgattacaacaatgttcaacaattattccaacaaactcaaccaagagttgctggtgtcttccatttagctaatcgttttgctccaggtttaattagtacttctgaccttgctttacttcgtaagggctttaatgctaaggctgaaggtgcttggaacttacacaaggttactgctcaaaagcaacatcaagttcaactctttgttgtcttttcttctattcttgacgttttaggtaaccgtggtcaaaccgcctatggtgctgctaatgccttcttaagttctatcattgatcaccgtagagaaaatggtctttctggtaattgtatcgctcttccagctatgcgtggttctggttacttggctaaatggaaccaaactaagcaatctaaggaatttgaacaattaattgccct

SEQ ID NO: 25994 - DNA, 714 bp, Piromyces finnis
  NAD(P)-bd_dom
acgttttgatgaacgtgtagtagtcattaccggtgccggtggtggttttggtcgagcccatgcctttttattcgcttctcgaggcgcaactcttgttttaaatgataatgctattatttcaaataataatggtcaaccaaaatatttagttgatgatgttgttaatgaaattactaaagctggtttccatgccattgctaactatgaaccaattgaaaacggagataagatcatcgaagctgctatgaacgctttcggaagaattgatattttaattaataatgctggtgttacttgcaataagccattcaatgaaatgtcagataaggactgggaatatgtacaaagtgtcaatcttcatggtgcctacaaggttaccaaggctgtctggccaattatgcaaagacaaagatatggtagaatcattaatattgtttctgctgctggtctttacggtagttacggtcaagctaattattcttcagccaagatggctttacacggattcactttatctttagctagagaaggttacagatacaacatttattgtaattgtgtttcaccatacgttgccttaaattatgatgcttctattaaagataaatctgttcaagttgtcaagccagaattcttatccccacttttagttttccttacccatgaaaataccagagaaaatggttctcactttgaagctggtgctggttatat

SEQ ID NO: 25995 - DNA, 792 bp, Piromyces finnis
  NAD(P)-bd_dom
taacaatgaatccattggtgaattatccttcaagggtagagttgttattgttactggtgctggtggtggtcttggtcgtgcttacgccaagcactttgctaagttaggagcttctgttgttgttaacgatttaggtgtccttttacgtggtagaggtgccaatactcaagttgctgatagtgtcgttgaagaaattaagagtatgggaggtattgctgttccaagttatgactctgttgaagaaggtgaaaagattgttgaaactgccatcaaaaactttggtcgtgttgatgttatcattaacaacgctggtattttaagagatagatcctttgctagaatgaccgatactgattggatgatgacctacaaggttcacttaaagggttgttacaaggttactaaagctgcttggccatacatggttaaacaaaagtacggtagaattattaatattacatctgctgccggtcttttcggtaactttggtcaatctaactatgctgctgctaaggctggtgttattggtctcactaatactttagccttagaaggtaaggaacacaatattactgttaatagtattgctccaaatgctggtactagaatgacagctactattatgccacaagaaatggttgaattactcaagccagaatacacagccccattaattagtttccttacccatgaatcatgtacagctactggcggtatctatgaagttggtagttgctggatcgctcgtatccgttggcaacgtagtggtggtgcttctttcgccatcaacaa

SEQ ID NO: 25996 - DNA, 264 bp, Piromyces finnis
  NAD(P)-bd_dom
aaataaatcctatttgattaccggtgcttttggtggtattggcttaaaagttggtctttggatgcgacttcgtggtgctcgtcatattgtattaacaacatcgtctgatccagagagtaaatataagcatccaattgttaatgctttacgtcaaaaaggtgttcatgtcaccattactaaatgtgatatttcaaagtatgatgaagttgaaaagcttttcatggaaaccacaccagcaatcgatggtgttttccatttcgctaa

SEQ ID NO: 25997 - DNA, 486 bp, Neocallimastix californiae
  NAD(P)-binding Rossmann-fold domains
tccaagtgaatatgctgctcctttaatgtgtgctggtgctacagtttataatccacttcgtttattcattgaaaaaccaaatgttaaagttggtgttattggtattggtggtttaggtcatttagctgttcaatttgctagtaaaatgggttatgaagttactgctctttctacttcttataataaaaaagaagaagctactggttttggttgtcataactttgttttattaaaggaagctgctgaaaaagttccaaattatttcgatttaattattaatacttctccatatgatatggattggaaaatgcttttaggtttacttagaccaaatggtaaattatgtttaattggtattccagctgttgatatgaaagttccagttatgccaattattttctctcaaaagactatttgtggttctattgttgctggtagaaaattcactaatgaaatgcttgaatttgctgccttaaatggtgttaa

SEQ ID NO: 25998 - DNA, 516 bp, Neocallimastix californiae
  NAD(P)-binding Rossmann-fold domains
tactgtagatgcttgtatgctttcagatatggttccaacaggttttcatgctgttgaacttgctgatattcaatttggtgatgttgttcttcaaattggtattggtccagttggtcttatgtctgttgctggtgcttctcttagaggtgcttcacgtattatttgtgttggaactcgtaaagtttgtcaagatgttgctagaaaatatggtgctaccgattttatttcatacaagaatggaactattgaagaacaagttatgaaattaactgatggcaaaggtgtcgatcgtgtatgtattgctggaggtacggtaaaaactttcgaatctgctattaaatgtcttaaaccaggaggtaagattggtaatgttaattatcttggttccggcgaattcgttaccattcctcgtgtagaatggggtgttggtatgggtcataaggatatccgaggtggtcttatgccaggtggtagacttagaatggaaaagcttgcttccctagttgtggctggtcg

SEQ ID NO: 25999 - DNA, 513 bp, Neocallimastix californiae
  NAD(P)-binding Rossmann-fold domains
tacgattttaattaccggtggtcttggtggtgtcggtttcgatatttctcgctacttgatgagacaacccaaccttaaggctcttgtacttactggtcgtagaccagaaacggatgaaaaggtagccggtaagttagccgaacttcgtgccctcaatccaaagattaaaattacctatgttaccgccaatgttggttctgaaaccgagatgaagaaggtcattgacgatattaacgctggaagtccagaagaagctttagttggtgtcttccacacagccggtactaatgatgatggtttaatctttaaccaatcgtatgaacgttttgccaagttaattaatagtaagattgaaggtacactttgtattgctaagcttactaatgatttgaacttgaagttcacaatactcttctcttcgatgaccgccttctttggtaatcgtggtcaaattaactactgtaccgctaatatgtttattaataaggtctgtgactactaccgtaatcatgg

SEQ ID NO: 26000 - DNA, 498 bp, Neocallimastix californiae
  NAD(P)-binding Rossmann-fold domains
tggtttattcggtatgccaggtatgactgcttgggctttcttcaacaaggccggtaagccaaaagaaggtgaaactatcttcgttactgctgccgctggtgctgttggtcaagttgtttgccaacttgctaagcttaagggtttaagagttgttgcttgtgcttcctctccagaaaagattggtttcttaaagcaagccattaaggtcgatgaagctttcagttaccgtgacttcccagacaaggaatccttcactgctcaattacgtaaggtttgtccaaacggtatcgatatctactacgataacgttggtggatacattcttgattctgctcttgaacttatgaacattcacggtagagttattatgtgtggtatgatctctcaatacaaccttaccgaaaagtacaagtacactcttagagatattacttccagaagacttactcttcaaggttgtttattcaacgattacttcccacaatgcatgggtgaatt

SEQ ID NO: 26001 - DNA, 735 bp, Neocallimastix californiae
  NAD(P)-binding Rossmann-fold domains
atccttcaagggtaaggttgttattattactggtgctggtggtggtctaggtcgtgcttacgctaaacattttgctaaattaggtgcttctgttgttgttaatgatttaggtgtccttttacgtggtagaggtgctaacactcaagttgctgatagtgttgttgaagaaattaagcaaatgggtggtattgctgttccgtcttatgattctgttgaagaaggtgaaaagattgttgaaaccgctattaagaactttggtcgtgttgatattattattaataatgctggtattttaagagatagatcttttggtagaatgactgatactgattggatgatgacatatagagttcacttaaagggtacttataaggttacaagagctgcttggccatacatgatgaaacaaaagtatggtagaattattaatattacttctgcggctggtctttttggtaactttggtcaatctaattatgctgctgctaaatctggtgttattggtctcactaatgcattagctttagaaggtaaagagtataatattactgtaaatagtgttgctccaaatgctggtactagaatgacagctactattatgccacaagaaatggttgaattacttaaaccagaatatactgctccacttattagtttccttactcatgaatcttgtaatgctactggtggtatctatgaagtaggtagttgttgggttgctcgtttacgttggca

SEQ ID NO: 26002 - DNA, 720 bp, Neocallimastix californiae
  NAD(P)-binding Rossmann-fold domains
acgttttgatgaacgtgttgtagtcattaccggtgccggtggtggctttggtcgagcccatgcattcttatttgcttctcgaggtgcaactcttgttttaaacgataatgcaatcatatctaataataatggacaaccaaaatatctagtcgatgatgttgttcgtgaaattactaaagctggttttcatgctattgctaattatgaaccaattggaaatggtgataagatcattgaagctgcaatgaatgcttttggaagagttgatattttaattaataacgctggtgttacttgcaataaacctttcaaagaaatgtctgataaggattgggaatatgttcataatgttaatcttcatggtgcttataaggttactaaagctgtttggccaattatgcaaaaacaaaagtacggtagaattattaatattgtttctgcagcaggtctttatggtagttatggtcaaactaattactcctcagcaaaaatggctttacatggctttactttatctttagctagagaaggttatagatacaatatttactgtaattgtgtttcaccatatgttgctttaaattatgatgcctctattaaggataaatctgttcaagttgtaaagccagaatttttatcaccactcttagttttccttactcatgaaaagactcgagaaaatggttctcactttgaagcgggtgctggttatattggtaa

SEQ ID NO: 26003 - DNA, 720 bp, Neocallimastix californiae
  NAD(P)-binding Rossmann-fold domains
acgttttgatgaacgtgtagtagtcattaccggtgccggtggtggctttggtcgggcccatgccttcttatttgcttctcgaggtgctactcttgttttaaacgataatgccatcatttctaatagtaatggtcaaaaaaaatatttagttgatgatgttgttcatgaaattactaaggctggtttccatgccattgctaattatgaaccaattggaaatggtgataagattattgaagctgctatgaatgctttcggaagagttgatattttaattaataacgctggtgttacttgcaataaaccattcaaagaaatgtctgataaggattgggaatatgttcataatgttaatcttcatggtgcttacaaggttaccaaggctgtctggccgattatgcaaaaacaaaagtatggtagaattattaatattgtttctgcagctggtctttatggtagttatggtcaaagtaactactcttcagctaaaatggccttacatggttttactttatccttagctagagaaggttatagatataatatttattgtaactgtgtttcaccatacgttgccttaaattacgacgcttctattaaggataaatcagttcaagttgttaaaccagaatttttatcaccactcttagttttccttactcatgaaaaaaccagagaaaacggttctcatttcgaagctggtgctggttacattggaaa

SEQ ID NO: 26004 - DNA, 735 bp, Neocallimastix californiae
  NAD(P)-binding Rossmann-fold domains
atccttcaagggaagagtagttattgttactggtgctggtggtggtcttggtcgtgcctatgctaagcactttgctaaattaggtgcctcagtcgttgttaatgatttaggtgtccttttacgtggtagaggtgctaacacacaagttgctgatggtgttgttgaagaaattaaaaagatgggtggtattgctgttccatcctatgattctgttgaagaaggtgaaaaaattgttgaaactgctataaagaactttggtcgtgttgatattattattaataatgctggtattttaagagatagatcttttgcaagaatgactgatactgattggatgatgacatacagagttcatttaaaaggtacctataaagttactagagctgcttggccatatatgatgaagcaaaagtatggtagaattattaatattacctctgctgccggtcttttcggtaactttggtcaatctaactatgctgctgctaaatctggtgtcatcggtctcactaatgccctagctttagaaggtaaagaacataatattactataaatagtgttgctccaaatgctggtactagaatgacagctaccattatgccacaagaaatggttgaattacttaaaccagaatacactgctccacttattagtttccttactcatgaatcttgtaatgttactggtggtatctacgaagtcggtagttgttgggttgctcgtttacgttggca

SEQ ID NO: 26005 - DNA, 549 bp, Neocallimastix californiae
  NAD(P)-binding Rossmann-fold domains
taagataagcgctgcaactatttctgttaatcctccaacagcttatagaatgttaaaggactttgttaacttaaaaaaaggtgatgttgttattcaaaacggagctaatagtgcagttggtcaatctgttattcaaattgctaaagcttggggtattaaaactattaatgtcatacgtgacagaccaaattttgaagaagttgctggagaattacataaacttggtgctacattagttattaaagaagaggatttacgttctaattctactcgcgaacttgttaagaacttaggtagtccagttcgtttagctttaaattgtgtcggaggaaagtcagcttctggaattacacgtttacttggccaaaatgctactattgttacctatggaggtatgtctaagcaaccacttactttcggtactggtccatttatttttaagaatttacgtgcaagtggtttttggatttctcgttggaacaaagaagcttcaaagaaagataagcaatatatgtttgatgatatttgtgaacttgttcgaggtggtca

SEQ ID NO: 26006 - DNA, 618 bp, Neocallimastix californiae
  NAD(P)-binding Rossmann-fold domains
tattcttattactggtggtttaggtgatgtaagtatggatgtcgttaattctctcctagctgacaaggacagtaaattggaacacattttccttctcggtagatccagtaagactaacagtagagttattgaaaagttagctcgtattgaaaaggtaaggaaagatcatgataaaaatattcaaattgaatattattcttgtgatatttctgatgaatcctctcttgctgaagtattcaatgatattcgtaaacgtcaaggcttacaaattactggtattttccatactgctggtgtcaacagtgatgccaacttcttaagccaatcctatgaaaaattagttgaaattgctccttcaaagattattggtactcataatattatgaaactttctgaagaatttaaggatgaacttaagtttgttgtctttgtttcatccctttctgctgttagtggtaacggtggtcaaactaactatactgctgctaatatgttcattgatgcgcttgctagatattataatgaccacggaagaactaatgtcatcgccatcgaactcggtggttggaagggagctggtagtagtgatcaattagttaatgattttatggtcattac

SEQ ID NO: 26007 - DNA, 495 bp, Neocallimastix californiae
  NAD(P)-binding Rossmann-fold domains
tgatttagctgtggctagtccacttctttgtgcaggtattactacttacagtccattaaaacgttataatattggtaaaggatctcgtgttgcaattatgggtttaggtggtttaggtcaccttggtgtacaatttgctcatgctatgggagctgaagttaccgttcttggtcattcagaatccaaaaaagaggaagccaagaaacttggagccgattgttatgaaattttaaagactgatgaagatttcaaaaaatattacagaacctttgattttattttaaattgtgctactgctaatcttaatttagataaccattttaaattattaaaaccaaatggtgtcctatgttttgttagtattgtaccagaggaacaaaggtttagtgaattaaatctttttggtaatcaagcttccataacagtttctaatgttggtggtattggtatcactcaagaaatgttaaacttttctgctgaaaaaggtattaaacc

SEQ ID NO: 26008 - DNA, 450 bp, Neocallimastix californiae
  NAD(P)-binding Rossmann-fold domains
tgaatatgctggtatctttattgttttcattactgcttattacagtttacatgttcgtgctggtggtattaaacccggccaaactattttaattcacgccgctgctggaggtgtaggtcaagctgccgtgaagttatgtcaactctggggtgctaatattattgccagtgcttctgcttcgaagcaacaattccttcgtgatacttatggtcttgagcatgtaaccaactccagagatccagaagaattctaccgtgatgtgatgaagtggactgatggtaagggcgttgactttgtgttaaactctctttccggaaagagtcttaaaatgggtattaagtgtttgaagaatggtggtaagtttgttgaaattggaaagactgatattttaaatgacagcaagttaggtctacattgtcttcttaataatatctcctttgtctcatcaca

SEQ ID NO: 26009 - DNA, 579 bp, Neocallimastix californiae
  NAD(P)-binding Rossmann-fold domains
tttaacctatttaattactggtgcttttggtggtgtcggtttaagagttgttctttggctagttagccgtggtgccaagaacattttattaaccactagtagttctgttgaaaaacaatatgaacaaccaattattagatctttattggaaaagggtattaatgtaatgattaagacctgtgatattactgatttgactagtgttcaacaattattccaacaaactactccaagaattgctggtgtcttccatttagcaaatcgctttgctccaggtttaattagtacttccgatcttgctttgcttcgtaagggcttcagtgctaaggctgaaggtgcatggaatttacacttggttactcttcaaaaggctcatcaagttcaattgtttgttgtcttttcttccattcttgatgttttaggtaatcgtggtcaaactgcttatggtgctgctaatgctttcttaagttctattgttgatcatcgtagagaaaaaggtctctctggtaattgtattgctcttccagctatgcgtggttctggttacttagcaaaatggaatcaaacaaaacaatctaa

SEQ ID NO: 26010 - DNA, 702 bp, Neocallimastix californiae
  NAD(P)-binding Rossmann-fold domains
ctttactggtaagcatgttcttatcactggttgtggtagaaactcaattggtgaatgtgttcttaagtacctcttagctggtggtgctaaggttgttgctactacctctagctaccgtcgtgctaccatggaacactttagaagtgtatatgaacaagttggtactaagggttccactttagttgttgttccattcaaccaaggttctaagaaggatgtcaatgatctcattgaattcatctactctaaggatagtcgtgtcaacggtctcggttgggatcttgacttggttattccattcgctgctatctctgaaaatggtcgtgatattagtgacttggatggtaagagtgaattagctcaccgtattatgatgaccaatgttattcgtattcttggtgctgttcgtactcaaaagatgaaggttggttcacttgtctctgctcaagttatccttccattatctcctaaccacggtacttttggtggtgatggtttatacggtgaatctaagattggtttggagaacctcttaaaccgttggagatctgaaacctggtctaagtacctttctatcactggtgcctgcatcggttggacgagaggtaccggtttaatgaacagtaacaaccttatctctgaaggtattgaaagccaaggtacctgccgtactttcactaccactgaaatggccttcaactt

SEQ ID NO: 26011 - DNA, 597 bp, Neocallimastix californiae
  NAD(P)-binding Rossmann-fold domains
aaataaagcatatttaatcactggagctttcggtggtgttggtttacgtgttgctgaatggcttcagttaagaggtgccaagaatattgttttaactacatctggtaatatagaaaagcgtaacagaaaccctattgtggaaactcttcgtagtaaaggtgtccatgtgacagttacccaatgtgacatttcaaatattcatgctgtccgtaagttattccaagaaacaacaccacaaattgctggtattttccatctagctaataaatttgctcctggattgattcaaagaacttcccttgaacaattccatgttgcttataatccaaaagcaagaggtgccttaaaccttcatttagttagtaaagattatccaatagatatgtttgttatgttttcttctgttcttgatcttttaggtaataagggccaagctgcttatggcgcagctaattccttccttggttccttagttgaacttcgtcgttcgcaaggtttatgtggttcatgcctttccttgccagcgatgaagggttccggttaccttgctcaattcaagcaagaaagacaagcaaatcaattcaagggattaatcac

SEQ ID NO: 26012 - DNA, 417 bp, Neocallimastix californiae
  NAD(P)-binding Rossmann-fold domains
cggtactgtcttatatgcccttcgtgatcgtgctggcggtgttaaacgaggtcaaagcattttaattcactctggagctggtggtgttggtcaagcagctattaaattatgccaatattggggtgcaaagatatttgttagtacttcagctaaaaaagtccaatacttgaaggatatgtatggtttagaatacattactaattccagagattcgaagactttttataacgatattatgaaatggacaaataatgaaggtgttgactttgttttgaatgccctcgctggtgatggtattacatatggacttaagtgcttaaagaagggtggtcattttgttgaaattggaaagaagaatattatctttaatactccattaggcttaaaaagtttaatgaacaatattaatttctgttc

SEQ ID NO: 26013 - DNA, 738 bp, Neocallimastix californiae
  NAD(P)-binding Rossmann-fold domains
taagaacaagtatgttttaatcactggttgtggtcgtaactccattggttcccaaattattaagggattattaaatggtggtgctaagattattgctactacttccagattcagtaaggcaaccatgcaatactaccgtcaactctatgaagatcatggttctaagggatcttgcttaattgttgttccattcaatgccgcttctgttgaagatgttaatcgcttaatcgattacatttactctaaggatccaaagaatggtttaggatgggatcttgattacgttattccattcgctgccatctccgaaaatggtagaactttagaaaacattgacagtagaagtgaattagctcatagaattatgcttactaacttattaagaatgttaggtaagattgttagccagaaggaggctcacaagtatgatactcgtccagctcaatgtattcttccaatgtctccaaaccatggtaccttcggtggtgatggtctctactctgaatccaagattgctcttgaaaccctcttcaaccgttggcattcagaaggatggggaggttaccttaccgttgctggtgccgtcattggttggaccagaggtactggtttaatgaatagtaataaccttgttgctgaaggtattgaaatgtttggtgttcacactttcagtactcatgaaatggccttcaaccttattggtttaatgcacagtgacatttgtaagctctgtcttaa

SEQ ID NO: 26014 - DNA, 573 bp, Neocallimastix californiae
  NAD(P)-binding Rossmann-fold domains
agataaatcctatttagttacaggagcctttggtggtgttggtttaagagtttgtctttggatgcaacttcgtggagctcatcatcttgtattgaccacttcttctaatcctgaaagtaaaaaggatcatccgatagtgaaggccttacgtcaacgtggcgcgcaagtctcgattgttaaatgtgatatatccaagtatgatgaagtagaaaagctctttaaggaaaccagtccatccctggatggagttttccactttgctaataaatttggaccaaaacttattcgtgattctggtcttgaaagctttattgccacctatgaacctaaagctcgtggagctcttaatcttcataagattagtcaaaagggttatcctctctccacctttgtcctcttttcctctgtcctcgatcttctcggtaataccggtcaaattgcctatggtggagccaatgccttcctcggtaatcttgtatattaccgtagaagacaaggactctctggtcaatgcttctccttacccgccatgaaaggttcaggttatctttcacaatggaaacaggaaggaca

SEQ ID NO: 26015 - DNA, 495 bp, Neocallimastix californiae
  NAD(P)-binding Rossmann-fold domains
tgatttagctatggctagtccacttctttgtgcaggtgttactacttacagtccattaaaacgttataatattggtaaaggatctcgtgttgcaattatgggcttaggtggtttaggccatcttggtgtacaatttgctcatgctatgggtgctgaagttaccgttcttggtcattcagaatccaaaaaagaggaagccaagaaacttggagccgattgttatgaaattttaaagactgatgaagatttcaaaaaatattacagaacttttgattttattttaaattgtgctactgctaatcttagtttagataaccatattaaattattaaaaccaaatggtgtcttatgttttgttagtattgtaccagaggaacaaaagtttactgaaatgaatctttttggtaatcaagctaccataacagtttctaatgttggtggtattgatatcactcaagaaatgttaaacttttctgctgaaaaaggtattaaacc

SEQ ID NO: 26016 - DNA, 765 bp, Neocallimastix californiae
  NAD(P)-binding Rossmann-fold domains
taaaaataagtatgttttaattactggttgtggtcgtaattccattggttctcaagtgattaagggattattaaatggtggtgctaagattattgctactacttctagattcagtaaggctactatgcaatactaccgtcaactctatgaagatcatggttctaagggatcatgtttaattgttgttccattcaatgctgcttctgttgaagatgttaatcgtttaatcgaatacatttactccaaggatccaaagaatggtttaggatgggatcttgattatgttattccattcgctgctatctccgaaaacggtagaactttagaaaacattgatagtagaagtgaattagctcatagaattatgctcaccaatttattaagaatgttaggtaagattgttactgaaaaggaatcgcataagtatgatacacgtcccgctcaatgtattcttccaatgtcaccaaaccatggtacctttggtggtgatggtctctactctgaatccaagattgctcttgaaaccctcttcaaccgttggcattcagaaggatggggaggttatcttactgttgctggtgctgtcattggttggactagaggaaccggtttaatgaatagtaataaccttgttgctgaaggtattgaaatgtttggtgttcacactttcagtactcatgaaatggccttcaaccttattggtttaatgcacagtgatatttgtaagctttgccttaagaacccagtctttgctgatcttaatgg

SEQ ID NO: 26017 - DNA, 147 bp, Neocallimastix californiae
  NAD(P)-binding Rossmann-fold domains
cgaacttaagaagattgctgaagatggtatctccttcgctggtaagcacgttcttatcactggttgtggtagaaactcaattggtgaatgtgttcttaagtacctcttagctggtggtgctaaggttgttgctactacctctagcta

SEQ ID NO: 26018 - DNA, 543 bp, Neocallimastix californiae
  NAD(P)-binding Rossmann-fold domains
ctccggtaccgtcttaattactggtggtactggtggtgttggtttcgatatctgtcgctacctcgttaaacaagctaaccttaagggtcttgtccttactggacgtcgaccagaaaccgatgaaaaggttgctggtaggttagccgaaattcgtgcccttaatccaaagattaagattacctatgtcaccgctaatgttggttctgaacaagaaatgaagaaggtctttgatgatattaactctggctctccagaagaagcccttgttggtgttatccatactgctggtaccaacgatgatggtttaatcttcaaccaatcctatgaacgtttcgcaaagttaattaacagtaagattgaaggtgctctctgcattgctaagcttacggaaggtttgaacttaaagttcaccattctcttctcctccatgacggccttcttcggtaaccgtggtcaaattaactactgtacggctaacatgttccttaacaaggtttgtcagttctaccgttcccacaacggtcgcaaggatattatgtctct

SEQ ID NO: 26019 - DNA, 654 bp, Neocallimastix californiae
  NAD(P)-binding Rossmann-fold domains
ggataaatcttatttggtgaccggggcttttggtggtgttggtttaagagtttgtctttggatgcaacttcgtggagctcatcatctcgtccttactacctcctctaatcctgaaatgaagtatcatcatccaattgtgaatgccttacgtcagcgtggtgctgaagttaccattgtgaaatgtgatatttcaaagtataatgaggtggaaaaactttttaaggaaactactccagtgattgatggtgtcttccattttgctaataaattcggaccaaaattaattcgagattccaacctttcaggttttatctccacctatgagcccaaggcacgtggagcgctcaatcttcataaagttagtcaacagggttatcctctctccaacttcgttctcttctcttctgtattagatcttcttggaaataccggtcaaattgcttatggtggtgccaattctttccttggtaatcttgtctattatcgtagaagtaaaggactttcaggtcagtgcttctccttaccagcaatgaaaggttctggttatctttctcaatggaaacaggatgaacaatctcgtgaattctcggaagtcattgaattcttggatgcagaagatttaccagatattttagactttttcctcagagagga

SEQ ID NO: 26020 - DNA, 549 bp, Anaeromyces robustus
  NAD(P)-binding Rossmann-fold domains
tagtattagcgctgccaccatttctgtaaacccaccaactgcttacagaatgttaaaggattttgttaatttaaaaaaaggtgatgttgttattcaaaatggtgctaatagtgctgttggtcaatctgttatacaaattgctaaagcttggggtattaaaaccatcaatgttgttcgtgacagaccaaattttgatgaacttgcctctgaattacataaacttggtgctacattagttattaaagaagaagacttacgtgctaattctactcgtgaactcgttaaaagtttaggaagtccagttcgtttagctttaaattgtgttggtggtaaatctgcttctggtatcactcgtttacttggtcataacgctactatcgttacatatggtggtatgtctaagcaaccacttacttttggtactggtccatttattttcaagaatttacgtgcttgtggctactggaattctcgttggaataaagaagcttcaaagaaagataaacaatatatgtttgatgatatctgtgaacttattcgtggtggaca

SEQ ID NO: 26021 - DNA, 735 bp, Anaeromyces robustus
  NAD(P)-binding Rossmann-fold domains
aaactttaagggtagagttgttattgtaactggtgctggtggtggtcttggtcgtgcttacgctaagcatttcgccaaattaggtgcttctgtcgttgttaacgatttaggtgtccttttacgtggtagaggtgctaacactcaagttgctgatagtgttgttgaagaaattaagaaaatgggtggtattgctgtcccaagttatgattctgttgaagaaggtgaaaagattgttgaaactgctattaaaaactttggccgtgttgatgtcattataaataatgctggtattttaagagatagatcatttgctagaattactgatactgattggatgatgacttataaagttcacttaaagggtacctataaagttactaaggctgcttggccatatatgataaaacaaaaatacggtagaattattaatattacttctgctgctggtctttttggtaactttggtcaatctaattatgctgcagctaaatctggtgttattggttttaccaatgctttagcattagaaggtaaggaacacaatattactattaacagtgttgctccaaatgctggtactagaatgacagcaactattatgccacaagaaatggttgaattacttaaaccagaatatactgctccattaattagtttccttactcatgaatcttgtactgctactggtggtatttatgaagttggtagttgttgggttgctcgtttacgttggca

SEQ ID NO: 26022 - DNA, 720 bp, Anaeromyces robustus
  NAD(P)-binding Rossmann-fold domains
acgttttgacgaacgtgtagtcgtcattaccggtgccggtggtggttttggtcgagcccatgcttttttatttgcttctagaggggctactcttgttttaaacgataatgctgtcgtttcacataagaaaggtcaaacaaaatatgtcgttgatgatgtcgtcaatgaaattacaaaggctggtttccatgccattgctaactatgaaccaattggaaatggtgataagatcattgaagctgctatgaatgctttcggaagggttgatattttaattaataatgctggtgttacttgtaataaacctttcaaagatatgactgataaagattgggaatatgtacataatgtcaatcttcatggtgcctataaggttactaaggcagtttggccaattatgcaaaaacaaaaatatggtagaattattaatattgtttctgctgctggtctttatggtagttatggacaagttaattattcttcagctaagatggctttacatggtttcacattatcattagctagagaaggttatagatacaatatttattgtaactgtgtttcaccatatgttgcattaaattatgatgctacaattaaggataagtcagttcaagttgttaaaccagaatttttatctccacttttagttttccttactcatgaaaaaactagagaaaatggttctcactttgaagctggtgctggttacattggtaa

SEQ ID NO: 26023 - DNA, 549 bp, Anaeromyces robustus
  NAD(P)-binding Rossmann-fold domains
aaagattagcgcagctactatatctgtaaacccaccaactgcttatagaatgttaaaagattttgttaatttaaagaaaggtgatgttgttatacaaaatggtgctaatagtgctgttggacaatctgttattcaaatcgccaaggcctggggtatcaaaacaattaatgttgtccgtgatagaccaaactttgatgaatttgctgccgaattacataagcttggtgcaactttagttattaaagaagaagatttacgtgctaattctactcgagaacttgtaaaaaacttaggtaatccagttcgtttagccttaaactgtgttggtggtaaatctgcttctggtataacccgtttacttggtaataacgctacaattgttacctatggtggtatgtctaaacaaccacttactttcggaactggtccatttatcttcaaaaatttacgtgcttgtggtttctgggtttctcgttggaataaagaagcttcaaaaaaagataaacaatatatgtttgatgatatttgtgaacttattcgtggtggtca

SEQ ID NO: 26024 - DNA, 696 bp, Anaeromyces robustus
  NAD(P)-binding Rossmann-fold domains
ctttgctggtaaacatgttcttattactggttgtggtagaaattctattggtgaaaatgttttgaaatatcttattgctggtggtgctaaggttgttgctactacttcaagttatcgtcgtcaaactttagaacactttagaagtgtttatgaacaagtaggtactaagggctctactttagtcgttgtaccatttaatcaaggatctaagaaggatgttaatgatcttatagaatttatttattccaaggatagtcgtgttaatggtcttggatgggatcttgatttagttattccgtttgctgccatttctgaaaatggacgtgatattagtgatttagatggtaagagtgaattagctcatcgtattatgatgactaatgttattcgtattcttggtgctattcgtaatcaaaagatgaaggttcgttcccttgtttcctgtcaagttgttcttccactttcaccaaatcatggtacttttggaggagatggtttatacggagagtccaagattggattagaaaacttattaaaccgttggagatctgaaacttggtcaaactatttatctattactggtgcttgtattggttggaccagaggtactggtttaatgaatagtaataatcttatttctgaaggtattgaaagtgaaggacattgtcgtacatttactactactgaaatggcttt

SEQ ID NO: 26025 - DNA, 468 bp, Anaeromyces robustus
  NAD(P)-binding Rossmann-fold domains
cggtttattcggtatgccaggtatgactgcttgggctttcttcaacaaggtcggtaagccaaaagaaggtgaaaccatctttattactgctgctactggtgctgttggtcaagttgtttgtcaacttgctaaacttaagggtttaagagttgttgcttgtgcttcatctccagaaaagattggtttcttaaaacaagctcttaaggttgatgaagcttttagttaccgtgacttcccagacaagaaatcttttactgaacaattacgtaaggtttgtccaaatggtattgatatctattacgataatgttggtggatacattcttgattctgctcttgaagttatgaacattcatggtagagttattatgtgtggtatgatctctcaatacaaccttaaggacaaataccaatacactcttagagatattacttccagaagacttactcttcaaggttgtttattcaa

SEQ ID NO: 26026 - DNA, 612 bp, Anaeromyces robustus
  NAD(P)-binding Rossmann-fold domains
acttattaccggtggtttaggtgatattagtattgatatcatgaaatatttcttttctttagatcattgtaaattagatcatattttccttattggtagaagtagtaaatctagtgccaaggtcaatgataagttagctcgtcttgataaatctatgaaggataatggtaaaaatattgatattcaatactatccatgtgatatctctaatgaagctgcacttgctgaagttttcaatgatattcgtaaacgtcaaggtttacaaattaatggtattttacatactgctggtactaatagtgatgcctctttcattaatcaaacttatgataaattagttgaaattgctccagctaaaattcatggtactcataatatcattaaacttactgaagaatttaatgatgaaataaagtatattgttttattttcttccattactgctctttctggtttctcaggtcaaaccaattatactgctgttaatttattcattgataatattgctaaatattgtaaaaaccatggtagagacaatgttatgtctattgagttaactatttgggaaaatgctggtaactttgatcaactttatgctacagctatgagtat

SEQ ID NO: 26027 - DNA, 546 bp, Anaeromyces robustus
  NAD(P)-binding Rossmann-fold domains
tactattttaattactggtggtctcggtggtgttggttatgatgtttctaaatatcttattaccaaaccaaatcttaaagctcttgttcttactggtcgtagaccagaaacagatgaaaaggttgctgctaagttaaatgatcttcgttctgctagtaaaaatgttaaaattatttatgccgttgctaatgttaattctgaagaagaaatgaaaaaattatttgatgatattgctgcttcagaaaatccattaactggtataattcatactgctggtactaatgatgatggtttaatctttaatcaatcctatgaacgttttatgaaattagttcctggtaaggtagaaggtccacttattattactaaacttactaaggatataccaaatttaaaattcactattcttttatcttctatgagtagtttctttggtaatcgtggtcaaattaattataccactagtaatgtatttattaataaactttgtcgttactaccgtgctcatggtagaaaggatatggttgctttacaattagctgcctg

SEQ ID NO: 26028 - DNA, 738 bp, Anaeromyces robustus
  NAD(P)-binding Rossmann-fold domains
taaaaataagtatgttttaattactggttgtggtcgtaactctattggttctcaagttattaagggattattaaatggtggtgctaagattattgctactacatctagatttagtaaggctactatgcaatactaccgtcaactttatgaagatcatggttctaaaggttcatgtttaattgttgttccatttaatgctgcttcagttgaagatgttaatcatctcattgaatatatttattctaaggatccaaagaatggtttaggttgggatcttgattatgttattccatttgctgctatttctgaaaatggtagaactttagaaaacattgatagtagaagtgaattagctcatagaattatgcttactaacttattaagaatgttaggtaagattgtttctgaaaaagaagctcataagtatgatactcgtccagctcaatgtattttaccaatgtctccaaatcatggtacattcggtggtgatggtctttactctgaatcaaagattgctcttgaaacacttttcaaccgttggcattcagaaggatggggaggttatcttaccattgctggtgccgttattggttggacaagaggtactggtttaatgaatagtaataatttagttgctgaaggtattgaaatgtttggtgttcacaccttcagtactcatgaaatggctttcaatttaattggtttaatgcatagtgaaatttgtaagatgtgtcttaa

SEQ ID NO: 26029 - DNA, 594 bp, Anaeromyces robustus
  NAD(P)-binding Rossmann-fold domains
taaatcttatttaattactggtgcttttggtggtgttggtttacgtgttgctttatggcttcaattaagaggagctaaaaatattattttaacaacttcaggtaatgctgaaaaacgtaataaaaatccaattgttgaaggtcttcgtaataaaggtgttaatgttttagtacgtcaatgtgatatttctgatattaatgctgtacgtaaattattccaagaagctaatccaccaattgctggtatattccatcttgctaataagtttgctccaggtttaattgaaagaacttccttagaacaattccatgttgcttacaatccaaaggcaagaggtgccttaaatcttcatttagttagtaagaattatccagttgatatgtttgttatgttctcatctgtacttgatcttttaggtaataagggtcaagctgcttatggtgctgctaattccttccttggttctttagttgaacttcgtcgttctcaaggtttatgtggttcttgtctttctttaccagctatgaaaggatctggttatcttgcacaatttaaacaagaaagacaagctaatcaatttaaaggtttaattac

SEQ ID NO: 26030 - DNA, 417 bp, Anaeromyces robustus
  NAD(P)-binding Rossmann-fold domains
tggtactgttttatatgctcttcgtgatcgtgcaggaggtgttaaaccaggtcaaagtattttaattcaatctgctgctggtggtgtaggtcaagctgctataaaattatgtaaatactggggtgctaaaatttatgttagtacttcaacaaaaaagagagaatatttaaagaatttatatggattggagtatattactgattcaagaaatccaaagattttctatgaagatattatgaaatggactaataatgaaggtgttgactttgtccttaatgctcttgcaggtgatggtattacctatggtttaaaatgtttaaaaaaaggtggatgttttgttgaaattggtaaaaagaatattattttgaatacaccattaggcttaaagagtttaatgaataatattaatttctgttc

SEQ ID NO: 26031 - DNA, 477 bp, Piromyces finnis
  NAD(P)-binding Rossmann-fold domains
tggtttattcggtatgccaggtatgactgcttgggctttctttaacaaggttggtaagccaaaagaaggtgaaaccatttttgttagtgctgcttctggtgccgttggtcaagttgtttgtcaacttgctaagcttaagggtttaaaggttgttgcttgtgcttcttctccagaaaaaattggtttcttaaagggtgctattaaggttgatgaagctttcagttaccgtgacttcccagacaaggaatccttcgttgctcaattacgtaaggtttgtccaaacggtattgatatctactttgataatgttggtggatacattcttgattctgctcttcaacttatgaatgttcatggtagagttgttatgtgtggtatgatctctcaatacaaccttaaggacaagtaccaatacacccttcaagatatctctaacagaagacttactcttcaaggttgcttattcaacgattactt

SEQ ID NO: 26032 - DNA, 570 bp, Piromyces finnis
  NAD(P)-binding Rossmann-fold domains
tactattttaattactggtggtcttggtggtgttggttacgatatctctcgtttccttatgaaacaaccaaaccttaagggtcttgttcttactggtcgtagaccagaaactgatgaaaaggttgctgctaaattatcctccattcgtgaagttaataaggctattaaggttacctatattactgttaatgttggttctcaaactgaaatgaaagaggttattagtggtattaaggctagtggtagtaaattaactggtattattcacactgctggtgttaatgatgatggtttaattttcaaccaatcctatgaacgtttcgccaaattaattaacagtaagattgaaggttctcactgtatcgctaagattactgaaggtatgaacttggaatttattcttctcttttcttctatgacttccttctttggtaatcgtggtcaaattaactattgtgttgccaatatgtttgttaataaaattgctcactactaccgtagtcacggaagaaaggatattatcactttacaattagctgtatggccatccggtcttacctcaaagatttt

SEQ ID NO: 26033 - DNA, 549 bp, Piromyces finnis
  NAD(P)-binding Rossmann-fold domains
aaaaattagtgctagtactatttctgttaatccaccaactgcttacagaatgttaaaagacttcgttaacttaaagaaaggtgatgttattattcaaaatggtgctaatagtgctgttggtcaagctgttattcaaattgctaaagcatggggaattaagactattaatgttgttcgtgacagaccaaactttgatgaacttgctgatcaattacataagcttggtgccactttagtcattaaagaagaagacttacgtgctaacagtactcgtgaacttgttaagaatttaggaagtccagttcgtttaggtttaaactgtgttggtggtaaatcagccaatggaattacacgtttacttggacataatgcttctcttgttacttacggtggtatgtccaagcaaccacttacttttggtactggaccatttatttttaaaaacttaaaagcctgtggtttctggaactctcgctggaataaggaagcttcaaagaaggataagcaatatatgtttgatgatctttgtgaacttattcgtggaggtta

SEQ ID NO: 26034 - DNA, 423 bp, Piromyces finnis
  NAD(P)-binding Rossmann-fold domains
catgggtactgtattatatgctattcgtgatcgtgctggtggcattaaaccaggtcaaagtattttaattcagtcagcagctggtggtgttggtcaagctgctattaaattatgtcaatactggggtgctaaggtatatgtcagtacttctgctcgtaagagaaaatacttggaggacttgtatggattagaacacattacagattccagaaatccaaagactttctatgaagatattatgaagtggaccaacaacgaaggtgtggactttgtcttaaatgctcttgctggtgatggtattacctatggtcttaagtgcttaaagaaaggaggtcgtttcattgaaattggaaagaaaaacattattatcaatactccattaggtttaaagagtttaatgaataatatcaacttctgctctgc

SEQ ID NO: 26035 - DNA, 597 bp, Piromyces finnis
  NAD(P)-binding Rossmann-fold domains
ggataaatcatacatcattactggtgcttttggtggtgttggtttacgtgttgccttatggcttcaattaagaggtgccaaaaacattgttttaactacctctggaaatgctgccaaacgtaataagaacccaattgttgaaggtcttcgtagtaagggtgttaacgttaccgtttgtcaatgtgacatttcaaatattaatgctgttcgtaaattattccaagaaactactccacaagttggtggtattttccatcttgctaacaaattcttaccaggtttaattccaagaacttcattagaacaattccatattgcttacgatccaaaggctaaaggtgctttaaatcttcatcttgttagtaaggattacccaatagatatgtttgtcttattctcttctgtccttgatttattaggtaataagggtcaagctgcttatggtgctgctaattccttccttggttctttagttgaattccgtcgttccaaaggtttatgtggttcttgtatttctttaccagccatgaagggatctggttaccttgcccaattcaaacaagaaagacaagctaagggatttgaaggtttaattac

SEQ ID NO: 26036 - DNA, 579 bp, Piromyces finnis
  NAD(P)-binding Rossmann-fold domains
tcttttaatcacaggtggtttaggtgatgttagtatggatgttattgaaaatttgttatctgataaggaaactaaacttgaccacatcttccttttgggtagatctagtaaaactagtactaaggttgaagataaattagatcgtattgaaaaaattaaaaaggccaataataagaaaactgaagttgaatactattgttgtgatatttccaatggagattcattaaatgacgtattcaatgatatccgtaagcgtcaaggtttacaaattaatggtatcttccataccgctggtactaatgatgatactttattcttaactcaaacttacgaaaagtttgaaaaattagctccagctaaggttattggtactcataatattattaagtacacagaagattttaaggatgaattaaagtttatcattttaacttcttctcttactgccctttctggtttaactggtcaaaccaattatactgctgctaacatgtttattgatgccattgctagatattgtagaaaccatggaagaaataatgttatgtctttagaactttgtggttggtctggtgcagg

SEQ ID NO: 26037 - DNA, 654 bp, Piromyces finnis
  NAD(P)-binding Rossmann-fold domains
aaataaatcctatttgattaccggtgcttttggtggtattggcttaaaagttggtctttggatgcaacttcgtggtgctcgtcatattgtattaacaacatcgtctgatccagagagtaaatataagcatccaattgttaatgctttacgtcaaaaaggtgttcatgtcaccattactaaatgtgatatttcaaagtatgatgaagttgaaaagcttttcatggaaaccacaccagcaatcgatggtgttttccatttcgctaataaattcggtccaaagcttatcagggattctagcctagatagttttaatacagcatttgaaccaaaagcaagaggtgcattaaatcttcataaaataagtcaaaaaggattctcactttcttcctttgttcttttctcctctgttttagatattcttggtaattctggtcaaatggcatatggtgctgcaaattcttaccttaataatcttatttattatagaagacgtaaaggtctttctggtcaatgcttctcattaccagccatgaaaggttctggttacctttcccaatggaaccaaatcactcaatctcgtgaattttctgaagttatagaattccttgattcagaagacttacctgacattcttgactttttccttcgagatga

SEQ ID NO: 26038 - DNA, 720 bp, Piromyces finnis
  NAD(P)-binding Rossmann-fold domains
taagaacaaatatgttttagttactggttgtggtcgtaactctattggttctcaaattattaagggattattaaatggtggtgctaaaattattgctaccacttcaagattcagtaaggttactatgcaatattatcgtcaactttatgaagaccatggttctaagggttcatgcttaattgtagttccattcaatgctgcttctactgaagatgttaatagattaattgaatacatttactccaaggatccaaagaatggtttgggttgggatcttgattatgttattccatttgctgctatctctgaaaatggcagaaccttagaaaacattgatagtagaagtgaattagctcacagaattatgcttactaacttattaagaatgttaggtaagattgttagtgaaaaggaagctcacaagtatgacactcgtccagctcaatgtattttaccaatgtctccaaatcatggtacttttggtggtgatggtctttactctgaatccaagattgctcttgaaactctcttcaacagatggcattctgaaggatggggaggttaccttactatcgtcggtgctgtaattggttggactagaggtacaggtttaatgaacagcaataaccttgttgctgaaggtattgaaatgtttggtgttcacactttcagtactcatgaaatggcatttaaccttattggtttaatgcataatgatat

SEQ ID NO: 26039 - DNA, 720 bp, Piromyces finnis; identical to SEQ ID NO: 26038
  NAD(P)-binding Rossmann-fold domains

SEQ ID NO: 26040 - DNA, 720 bp, Piromyces finnis; identical to SEQ ID NO: 26038
  NAD(P)-binding Rossmann-fold domains

SEQ ID NO: 26041 - DNA, 720 bp, Piromyces finnis; identical to SEQ ID NO: 26038
  NAD(P)-binding Rossmann-fold domains

SEQ ID NO: 26042 - DNA, 453 bp, Piromyces finnis
  NAD(P)-binding Rossmann-fold domains
tgaatatgctggtatctttattgttttcattactgcttactacagtttacacgttcgtgctggtggtattaaaccaggtcaaaccattttaattcatgctgctgctggaggtgttggtcaagctgctgttaagttatgtcaactctggggtgctaacattattgcctcagcatcagcttctaaacaacaattccttcgtgacacctatggtattgaacatgtcaccaactctcgtgatccagaacaattctacagtgatgttatgaaatggaccaatggtaagggtgttgactttgtcttaaactctctctctggaaagagtctccgtatgggtattaaatgcttaaagaacggtggtaagtttgttgaaattggaaaaactgatatcttgaatgatagtcaattaggtttacattgtctccttaacaatatttccttcatttcttctcacat

SEQ ID NO: 26043 - DNA, 573 bp, Piromyces finnis
  NAD(P)-binding Rossmann-fold domains
cttaacctatcttgttactggtgcctttggtggtgttggtttaagagttgttctttggttagttagccgtggtgcaaagaaccttttattaactactagtggatcagttgaaaagcaatatgaacaaccaattattcgttctttaattgaaaagggagtcaatgttatgattaagacctgtgatatcactgattacaacaatgttcaacaattattccaacaaactcaaccaagagttgctggtgtcttccatttagctaatcgttttgctccaggtttaattagtacttctgaccttgctttacttcgtaagggctttaatgctaaggctgaaggtgcttggaacttacacaaggttactgctcaaaagcaacatcaagttcaactctttgttgtcttttcttctattcttgacgttttaggtaaccgtggtcaaaccgcctatggtgctgctaatgccttcttaagttctatcattgatcaccgtagagaaaatggtctttctggtaattgtatcgctcttccagctatgcgtggttctggttacttggctaaatggaaccaaactaagca

SEQ ID NO: 26044 - DNA, 735 bp, Piromyces finnis
  NAD(P)-binding Rossmann-fold domains
atccttcaagggtagagttgttattgttactggtgctggtggtggtcttggtcgtgcttacgccaagcactttgctaagttaggagcttctgttgttgttaacgatttaggtgtccttttacgtggtagaggtgccaatactcaagttgctgatagtgtcgttgaagaaattaagagtatgggaggtattgctgttccaagttatgactctgttgaagaaggtgaaaagattgttgaaactgccatcaaaaactttggtcgtgttgatgttatcattaacaacgctggtattttaagagatagatcctttgctagaatgaccgatactgattggatgatgacctacaaggttcacttaaagggttgttacaaggttactaaagctgcttggccatacatggttaaacaaaagtacggtagaattattaatattacatctgctgccggtcttttcggtaactttggtcaatctaactatgctgctgctaaggctggtgttattggtctcactaatactttagccttagaaggtaaggaacacaatattactgttaatagtattgctccaaatgctggtactagaatgacagctactattatgccacaagaaatggttgaattactcaagccagaatacacagccccattaattagtttccttacccatgaatcatgtacagctactggcggtatctatgaagttggtagttgctggatcgctcgtatccgttggca

SEQ ID NO: 26045 - DNA, 720 bp, Piromyces finnis
  NAD(P)-binding Rossmann-fold domains
acgttttgatgaacgtgtagtagtcattaccggtgccggtggtggttttggtcgagcccatgcctttttattcgcttctcgaggcgcaactcttgttttaaatgataatgctattatttcaaataataatggtcaaccaaaatatttagttgatgatgttgttaatgaaattactaaagctggtttccatgccattgctaactatgaaccaattgaaaacggagataagatcatcgaagctgctatgaacgctttcggaagaattgatattttaattaataatgctggtgttacttgcaataagccattcaatgaaatgtcagataaggactgggaatatgtacaaagtgtcaatcttcatggtgcctacaaggttaccaaggctgtctggccaattatgcaaagacaaagatatggtagaatcattaatattgtttctgctgctggtctttacggtagttacggtcaagctaattattcttcagccaagatggctttacacggattcactttatctttagctagagaaggttacagatacaacatttattgtaattgtgtttcaccatacgttgccttaaattatgatgcttctattaaagataaatctgttcaagttgtcaagccagaattcttatccccacttttagttttccttacccatgaaaataccagagaaaatggttctcactttgaagctggtgctggttatattggtaa

SEQ ID NO: 26046 - DNA, 264 bp, Piromyces finnis; identical to SEQ ID NO: 25996
  NAD(P)-binding Rossmann-fold domains

SEQ ID NO: 26047 - DNA, 508 bp, Anaeromyces robustus
  NODB
acattgggctatgacttatgatgatggaccaaccgaatttgctgatgcaattttagatcttttaaaggaaaaaggtattaaagcaacattcttcattgttggacatatgtatatggataataatagttctgattggtctagaattattaagagaatggatagtgaaggtcatattgttggtaaccatacttatgatcaccaagatttaactggactttcatcagatcaaattattagtcaaatgaaacaagttgaagatcgtatcttcaaaattattggtaagagaccagcatttatgcgtccaccatatggttcaggtaatggtaaccaaaatgttatgaatgcacttcaacaagctggttacacagctgctattaattggaatgttgatccacaagattacagtaatggtggtgatgctaattatgctagacaagttattaatcaagctaaaggtcaaccaatcattaccttaaatcacttaaaatacaacggcgcctctcaacaa

SEQ ID NO: 26048 - DNA, 933 bp, Neocallimastix californiae
  Oligoxyloglucan reducing end-specific cellobiohydrolase
aactcactgggctccaaatgttgtcggttttgaagaaacagccattaatgatattgaagctccaccatctggtccaggaattccaaaacttttgactgctttaggtgatcttggtggttttactcaagatgatattaatgaagccgtagaaatgtgggtcaatccaacttacaccactggtaactctgttgaatatgctgtctctaaccctaagattgttgtctcttgtggtactgataatgctgcttactctactgatggtggttacacctggactccaatgaagactttaccatatgaaaaggctactggtggtcatattactatttctggtgacggtaaggttgttacctggattccaaatcaatctcaaattccatactacactactgataatggtgccacctggactgctgttgatacttgtaagaattgtaaccaagttcgtccagatggtaagaatccaaaattaatgtacggtttcgattaccaaaccttatacattagtgaagatggtggtaagacttatattaagcaaggaggaaatatgggagctggtcaattaatgtcaccatacaatgtagaaggtcacttatggttagcttgtacctactggggaggtgttcaattctcatctgatatgggtaagacctttaaggaagttgatccaaaattcaaatctgctgattctgttggttttggtaaggctgctccaggatctgatgctccatacactgtttatattgttggtaaatatgatgattactatggtgtctaccgttccactgatcttggtagcacatgggaattacttaatgatgattctcatcaatggggtgtttacaatagtaaggttattggtgatccagatattttcggtcgtgtttacattgctaccaacggtagaggtgttgttgttggtgatgatactag

SEQ ID NO: 26049 - DNA, 1113 bp, Neocallimastix californiae
  Oligoxyloglucan reducing end-specific cellobiohydrolase
taactggtataacactaaaattggtggtggtggtttcgtcaccaatttaatttacaatccaggagaggaaggattattatatttaagaactgatatgggtggttcttaccgttatgatcaaacaaacaaatcatggattccaattcaagatgtttttggtggtagtgaatggtggttattcggttgtgaaagtttaggtgttgatactaaagaaccaaatcgtgtatatattgcagctggtacttacatgagttatggtgaaaatggtgcaattattagttcagatgattatggtaagacttggaaacatcgttgggatgccccattccactttggtgctaatgatgatggtcgtggtcgtggtgaaagacttgctgtcaacccagttgataataacatcattttcttcggtacaagaaagaatggtttatacaagtctactaactatggtgaatccttcgaaccagttaaaggttttccagctgaccatgatataccatttattcttttcgttccaggttctaagggtaaaactgtaattgttgctacagatgatactaaggctccattatacatcagtaaggatggaggttcctcctttgataaaattagtggtcaaccaaatattggttacttcccacaacatggtgctttcagtgctgatggtaaatacttatacgttacttatgctaattctattggtccaaatggagctactcaaggtgatgtttaccgtattagtcttccagatttcacttttaaggaaattactccagttcacggttcatacgaaactcagcaatttggttacactggtgttcaaaccagtggtactaacgcaggagttgttattgtttcaaccttaaacttatggtggccaagtgatgaagtttacatgagtactgattatggtgagacttggtcagaaggtgttgctagtcatgctgaattagatattagtgaatacccatggcttgatttcggtaaggaagataacttaaagttcggttggtggattgctgccttagctatggatccattcaatgatgataatgtttcctacggtactggtgctactgtttacactacaaccgaattcactaaagctatgaa

SEQ ID NO: 26050 - DNA, 873 bp, Neocallimastix californiae
  Oligoxyloglucan reducing end-specific cellobiohydrolase
tacaggagatgctcatttattgagtgttatgggtgatattggtggtttcagacacacagatttagataaatgtccagaaattaatttcagatcaccaaccttcactactggttattctattgattatgctgaaaatgttccaaacttctgggttcgtgtaggtacagaaccttatattgctatttcttggggtaatggtgaatcatggtattctggtcaagccccaggtggtgtaacggaaggtggtattgtagctgttggtgctgatggagatgtcgtttgggctccaaaaccttatgatttaggtgtcttctacggtaaggaatctttcaaatcttccaagggtattccaggtggtgccagaatttgttcagatcgtgtaaatggtaagattttctatggttaccttggagataccttctatcgtagtaccgataccggtgtcaccttctctaaagtttacacaggacttccagaaattgaaccaggttatgctaaaaatattaaggccgtagctggtcatgaaggcgatgtttggcttgccggtaataaaggtggtctctaccatacagaagatggtggtgaaacatttacatcaattgatggagtcgaaattgctaataccattggtttcggtaaggctgcagaaggttcagattatccagcactttacattaccggtaaaattggtaatgttaatggtattttccgttctgatgataagggaaagaattgggttcgtattaatgatgacgatcatcaatatggtactatcaatttctgtattacaggtgatccacgtatctatggtcgtgtctacgtttgtactaatggttatggtattgtctatggtgatatcgatggtgattctgg

SEQ ID NO: 26051 - DNA, 1194 bp, Neocallimastix californiae
  Oligoxyloglucan reducing end-specific cellobiohydrolase
taaatggaagaatgctgaaattgttggtggaggttttgtaccaggtattgttttcagtgaggctgaaaaagatttagtttatgctagaactgatattggtggtttatatcgtttaaataaatccacaaagagatgggaaaatttatcagaatgggttggagttgataattggggttatgctggtattgatactatgtgtgcagatccagtggatgcaaatagagtttatgctgctgttggtatgtatactaatgattgggatccaaataatggtgctattatttcatcaacagatcgtggtgataattggtctatttctgaattaccattcaaggttggtggtaatgatccaggtcgtggtatgggtgaaagaattgctgttgatcctaacaataataaaattcttttctttggtgctcgtgctggtaaaggtttatggaagagtacagattatgctaaaacttggtcacaagtcaagagttttactaatgtaggtaaatatgctgcagataatcaatacttcaccgaagccatcggtatttcatttgtaacttttgatcgttatagtggtaaaaagggttctccaaccccaaatatttatgttggtgtagctgataattccacatcaacagtttatgtttcaaaggatgctggtgtatcatggactgcaattcctgatcaaccagcccattatttcccacataaaggaaagattactgaagatggtatgctttacgttacttatactgatggttgtggtccatacgatggtcaagctggtgctatttatcgttacaatactaaaactggagaatggaaggatatcagtccacatcaagaaccatactttggttatggaggtttggcaattgatgctcaaaatcaaaagacccttgttgtagctactttgaattcatggtggccagatgccattttattccgttctactgatggtggtgatacttggtctcatatttgggaatgggatggctatccacaacgtaagcttaaatatgaaattgatccatctatttctccatggattgaagatgatatgaaacaaattccagaacctaccacaaagttaggttggatgattgaatccttagaaattgatccatttaattctgatcgtattatgtggggtacaggtgccactatttggggttctgaagatcttacgaattgggatag

SEQ ID NO: 26052 - DNA, 1107 bp, Neocallimastix californiae
  Oligoxyloglucan reducing end-specific cellobiohydrolase
taactggtataatactaatattggtggtggaggtttcgtcaccaatttaatttacaatcctgcagaggaaggattattatatttaagaactgatatgggtggttcttatcgttacgatcaagccaacaaatcttggatccctattcaagatgtattcagtggtagtgaatggtggttatttggttgtgaaagtattggtattgatacgaaggaacccaatcgtgtctatattgctgcaggtacctacatgagttacggtgaaaatggagccattattagttctgatgactatggtaaaacttggaagcatcgttgggatgctcctttccactttggagctaatgatgatggtcgtggtcgtggtgaaagacttgctgtcaatcccgtcgacaataacatcatttactttggtaccagaaaatctggtttatacaaatcaagtaattatggtgaatcttttgaacaagtaaaaggattccccactaaccacgatattccattcattcttttcgttccaggttctaagggaaaaaccatcatagttgctaccgatgatacgaaggcaccactgtacataagtaatgatggtggttccagtttcaagcaaattagtggccaaccaaatatcggttactatccacaacatggagctttcagtgctgatggtaaatatttatatgttacctatgccaattctattggtccaaatggagccacacaaggagacgtttaccgtatcagtcttccagattacaaatttaaggaggttactccagttcatggatcctatgaaacacaacaatttggttacaccggggttcaaaccagtggtactaatccaggtgttgttattgtctctaccttgaatctttggtggccaagcgatgaattgtacatgagtagtgactatggtgagacttggtctgaaggagttgccagtcatgctgaattagatattagtgaatacccatggcttgatttcggtaaagccgacaatttgaaatttggatggtggatagccgccttagccatggatcccttcaatgataataacgtttcctacggtactggtgctaccgtctacaccaccacggatttcactaatgc

SEQ ID NO: 26053 - DNA, 927 bp, Neocallimastix californiae
  Oligoxyloglucan reducing end-specific cellobiohydrolase
ttgggctcctaatgttcgtggatttgaagaaacagctattaatgatattgaagcaccacctgctggaccaggtattccacaacttttaactgcattgggagatcttggaggtttcacccaagatgatatccatgaaaccgtagagatgtgggtcaatccaacctacaccacgggtaactcagtagaatatgcagtctccaaccccaaaattgtagtttcctgcggtactgataatgcagcctattccaccgatggaggtcactcctggacaccaatgaaatccttaccctatgaaaaggccactggtggtcatattaccatttcaggggatggtaaggtagtgacctggattccaaaccaatcacaaaagccatactacaccaccaactatggtgcctcttggactgcagtcaacagctgtaataactgtattcaaattcgaccagatggtaagaatccaacgttgatgtacggttatgaccatcaagatctatacatcagtgaggatggaggtaaaacgtacaagaagcaagcaagcaacatgagttccggacagttgatgtcaccctatgaagttgaaggtcatttatggttagcctgtacctattggggaggggttcaaatatctacggataagggtaagaccttcaaggaagttgatccaaagtttaaaacagcagattccgttggttttggtaaggccgccccaggttccagcgctccatatacagtttatgttgttggtaagtatgatggatactatggtgtttaccgttccacagatcttggtagtacttgggaattacttaatgatgattcacaccaatggggagtctacaacagtaaagttattggagatccaaatattttcggacgtgtttacgtggctactaacggtcgtggtgttattgttggagatgataccag

SEQ ID NO: 26054 - DNA, 1194 bp, Neocallimastix californiae
  Oligoxyloglucan reducing end-specific cellobiohydrolase
tcaatggaaaaatgcagaaattgttggtggtggttttattccaggtattattttcagtgaagctgaaaaagatttaatttatgctagaactgatattggaggtttatatcgtatgaataaatccactaagagatgggaaaatttattaaaatgggtcggcgttgataattggaattatggtggtgttgatactatgtgcgctgatccaatagattctaatagagtatatgctgcagttggtatgtatactaatgattgggatcaaaataacggtgctattatttcatcaaatgatcatggtgatacatggtctataactgaattaccatttaaagttggtggtaatgatccaggtcgtggaatgggtgaaagaattgctgttgatccaaatgataataaaattcttttctttggcgcccgtgctggtaaaggattatggaagagcattgattatgctaaaacttggtcccaagttaaaagttttacaaatgtaggtaaatattcaccaagtcctgaatatttcccagctgcaattggtatttcttttgttactttcgataaatatagtggtaataagggatcaccaactccaaatatttatgttggtgttgctgataattctacttctactgtttatgtttctaaagatgcaggtgtttcatggactccaattccagatcaaccagctcattacttcccacataaaggtaaaattactaaagatggtatgctttatattacttattctgatggttgtggcccttatgatggtcaagctggtgctatttatcgttacaataccaagactggagaatggaaagatattagtcctcaccaagaaccatactttggttatggtggtttagctattgatgcacaaaatcaaaagaatattgttgttgctactttaaattcatggtggccagatgctatcttattccgttctactgatggcggtgatacttggtcccacatttgggaatgggatggttatccaaatcgtaaattaaaatatgaaattgacgcttccatttctccatggattgaagatgatactaaacaaattccagaaccaactactaaattaggatggatgattgaatctttagaaattgatccatttaattctgatcgtattatgtggggtaccggtgcaactatttggggttccgaagaccttaccaattgggacaa

SEQ ID NO: 26055 - DNA, 855 bp, Neocallimastix californiae
  Oligoxyloglucan reducing end-specific cellobiohydrolase
tggggaagctcatttaatgagtgttatgtatgatattggtggttttatgcatacagatttagatacttgtccaaaaacacaatttagaacaccaaatttttcttcaggtaattcaattgattatgctgaaaatgttccaaatttctgggttcgtgttggtaccgaaccatatatagcttattcttggggttcaggttcatcttggtatgctggtcatgctccaaatggtgttactgaaggtggtttagttgctgttggtgctgaaggtgatgttttatgggctccaaaaccatatgaactaggagtattctatggtaaggaatccttccaatcatctaaaggtattccaggtggtgctagaatttgttctgatcgtgttaacggcaagattttctatggttatcttggtgatactttctaccgtagcactgatactggtgctaccttcactaaaatgtacactggtctaccagaaattgaaactgggtttgccaagaacattaaggctgttgccgatcatgaaggtgatgtttggcttgccgctaataaaggtggtcttttccatactgaagatggtggtaagaccttcactcaaattaatggtataacgattgctaatactattggttttggtaaagctgctgatggttcagactatccagctctttatattactggtaaaattggagatgttaatggtattttccgttcagatgataagggtcaaaactgggttcgtataaatgatgataaaaatcaatatggcactataaatttctgtatcactggtgacccacgtatctatggacgtgtctacgtttgtactaatggttttggaattgtttatggtgatat

SEQ ID NO: 26056 - DNA, 927 bp, Piromyces finnis
  Oligoxyloglucan reducing end-specific cellobiohydrolase
ctgggccccaaatgtacatggttttgaagaatgtgctattaacgatattgaagcaccaccagctggacctggtaatccacaacttttaactgctcttggtgatcttggtggtttcactcaagatgatattaatgaagcagtagaaatgtggaccaacccaacctatactactggtagttccgttgaatatgcatactctaacccacaaattgtagtttcctgtggtacagataatgcggcctactcaaatgacggtggtcacacttggactccaatgaagtcactcccatatgaaaatgctaccggaggtcatattactatttctggtgatggtaaagttgttacttgggttccaaatcaatccaatgttccatactggactacagaccatggtgctacttggacaaaggtaactacctgtccacaatgtactcaaattcgtccagatggtaaaaatttaacattaatgtatggttatgattatcaaagtgtttacctcagtaaagatggtggtaaaacctatagtaaacttagttctggtttaagtgccggtcaattgaattcaccatttgatgttgaaggtcacttatggttagcctgcacctattggggtggtgttcaaatgtcaacagattatggtaaaacctttaaagaagttgatccactctttaaaactgctgattcagttggttttggtaaacctgatccaaattcaaatgctccatacacggtttatattgttggtaaatatgatggttattatggtgtctaccgttctactgatcttggtaatacctggaccttattaaatgatgataatcatcaatggggtgtttataactccaaagttatcggggatccaaacatttttggtcgtgtttatattgcaaccaatggacgtggtgttgttgttggtgatgatactag

SEQ ID NO: 26057 - DNA, 1113 bp, Piromyces finnis
  Oligoxyloglucan reducing end-specific cellobiohydrolase
taattggtataataccaagattggtggtggtggttttgtaacaaatttaatttataatcctggagagcaaggattattatatttaagaactgatatgggaggttcttatcgttatgaccaaaataataaatcatggactccaattcaagatatttttggtggtagcgaatggtggttatttggctgtgaaagtttaggtgttgatactaaagaaccaaaccgtgtctacattgctgcgggtacctatatgagttatggtgaaaatggagccattattgcttcagatgactatggtcaaacttggaaaactcgttgggatgcaccattccactttggtgcaaatgatgatggtcgtggtcgtggtgaaagactcgctgttcatcctgaacaaaacaatattatctattttggtaccagaaagaatggtttatataaatcaacaaactatgctgaatcttttagtcaagttgcttcattcccaacggactatgatattccattcatcctttttgtaccaggaaccaaaggaaaaacaattattgttgctactgataattctaaaggaccattataccgtagtgatgatggaggttctaccttcaagcaaataagcggacaaccaaatacaggttattatcctcatcatggtgctttcagtgccgataataaatatctttatgttacttacgccaattcaattggaccaaatggtgccactcaaggtgctgtttatagaattaaacttgctgattactcctttaaggaaattacaccagtaaaaggttcttatgaaactcagcaattcggttatactggtgttcaaactagtggcactaatcctggtgtagttattgtctctactttaaatttatggtggccaagtgatgaagtttacaaaagtaacgattatggtgagacttggtctgaaggtgttgctagtcatgctgaattagacattagtgaatatccatggcttgactttggtaaagaagacggtttaaaatttggttggtggattgcttccttagctatggatccatttgatgataataatgtttcctatggtactggtgctacagtttataccaccactgattttactaatgccgataa

SEQ ID NO: 26058 - DNA, 1194 bp, Piromyces finnis
  Oligoxyloglucan reducing end-specific cellobiohydrolase
tacatggaaaaatgctgaaattgttggtggaggtttcgttcccggtattgtatttagtgaagctgaaaaagatttagtatatgctagaacagatattggtggtttatatcgtttgaatacatcaactaaaagatgggaaaatttatccaaatgggttggagttgataactggggttatgcgggtattgatactatgtgtgctgacccagttgatgctgatagagtttatgctgcagttggtatgtatactaataactgggatccaaataatggtgctattatttcatcgacagatcgtggtgataactggtcaattactgaattgccatttaaagttggtggtaatgatccaggtcgtggtatgggagaaagaattgctgttgatccaaataataataaaattctttttttcggtgcacgcgcaggaaatggattatggaaaagtacagattatgctaaaacttggactcaagtaaagagttttactaacgtaggtaaatatgctacggatacacaatattttactgaagctattggtatttcttttgttactttcgataaatacagtggtaaaaagggttccccaaccccaaatatttatgttggtgttgctgataattctacctctactgtttatgtttctaaagatgctggtgcctcatgggttccaataccagatcaacctctacattatttcccacataaaggtaaaattactaaagatggaatgctttatattacatatactgatggctgtggtccatatgatggtcaagctggtgcaatttatcgttataacactaaaactggtgaatggaaggatattagcccacatcaagaaccatactttggttatggtggtttagctattgatgctcaagaccaaaaaacaattgtagttgctaccttaaattcttggtggccagatgccattttattccgttctacagatggtggtgatacttggtctcatatatgggaatggaatggttatccagaacgaaagtttaaatatgaaattgatccttctatttctccatggattgaggataatatgaaacaaattccggaaccaacaacaaagttaggttggatgattgagtctttggaaattgatccatttaattctgatcgtattatgtggggtactggtgctaccatttggggttccgaggatcttactaattgggataa

SEQ ID NO: 26059 - DNA, 900 bp, Piromyces finnis
  Oligoxyloglucan reducing end-specific cellobiohydrolase
agctgttcaagatttagtttctccaccttcaggtgatgcacatttattaagtgttatgggtgaccttggtggttttagacacactgatttagatacttgcccagaagtcaatttcagatcaccaactttttcttctggtttctctattgattacgctgaaaatgttccaaatttctgggttcgtgttggtactgaaccttacattgctctttcatggggtaatggtgaatcttggtatggtgtccaagctccaggtggtgtaactgaaggtggtattgttgctgttggtgccgaaggtgatgttgtatgggctccaaagccttatgatttaggtgtcttttacggtaaagaaacttttaaatcttcaaaaggtattccaggtggtgccagaatttgttctgatcgtgtaaatggtaagattttctatggttaccttggtgatacattctatcgtagtatagatactggtgtttcttttaccaaaatgtacactggtcttccagaaatggaacctggctatgctaaaaatattaaagcagttgctggtcatgaaggtgatgtttggctcgctggaaacaaaggtggtctttatcatacagaagatggtggtgaaactttttatcaaattgatggtgtagaaatcgctaatacaattggttttggtaaggctgccgaaggttatgattatccagctttatatattactggtaaaattggaaatattaatggtattttccgttctgatgataaaggtcaaaattgggttcgtattaatgatgataacaatcaatatggtaccattaacttctgtattactggtgatccacgaatttatggtcgcgtttatgtatgtactaatggttttggtattgtctatggtgatattgatggtgattccgg

SEQ ID NO: 26060 - DNA, 690 bp, Neocallimastix californiae
  Pectin lyase-like
tcaaggtgaaaatatcaataatttagaagttgttgtaccaaagcttgataccattatagaaatgagaggtaacactcctcttaaaagctatgtgcaaaatattgtattcaatggaataacatttgcttattcagattggaatttatacgaacttaatgatggaggaaaattatcacatggttacgcctctgttcaaggtgctattgttatgtcagctttcggtcaagaagatcaacacaacgatatttaccgtacttatgatgttccagtatctgcaatttacattaattcttcaagaaacgttaaattccttaacggtgaaataagacatactggtagtattggtatgcatcttgaaaatgatgtcaatgatatagaagttactggtaattacattgctaagactagtggtgcaggtattgttattggtcatccaacacatgtatatgaaaatgataataatagacattcagttggttccaactttgctggtccagacaaggaaaagttcaaaaatggtaccgaatctgttcccaagaatatttcagttactaacaattacttacttgaaaactgttattccttctccggtcactcaccaattacttcattctatacttataatcttcaagttcttcacaactttgtctacaaatgttcttacagtggtatgagtattggttggggttg

SEQ ID NO: 26061 - DNA, 273 bp, Neocallimastix californiae
  Pectin lyase-like
tgatttctatgtatcagttgatggtagtgattcaaatgatggatctaaggatagtccatttgcaactcttgataaggcacgtcaagcagtaagaggcctttcaaagacaaagaatattgttgttgaaattgctgatggtttctatcctgttgataaaactatcaagtttacatcagaagattctggtaataacaaatcaacaatttattataagagtgctaaaggtgctcatccaattattagtggtggtgaaaagattactggttcatggac

SEQ ID NO: 26062 - DNA, 702 bp, Neocallimastix californiae
  Pectin lyase-like
gactgctaagcaaaactattcaaagccaatcgccttccctggtgctgatggtggaggtaaatttgctactggaggtcgtggtggtgaagtttattatgtaactaatttaaatgatagtggtgctggttcatttagagatgcagtcagtagatcaaatcgtattgttgtttttaaggttagtggtaccattgaattaaaaagtgatgttgttgttaaaggtaatataactgttgcaggtcaaacagctccaggtggtcatggtgtcgttttaaagaatttcaaaattggtttaggtggaacaaatattattcttcgtttcattggatcaagaccaggtgaaagaggctcgaatgcagattatgatgcttttggtggggctgaaggaagcaacagtattgtagatcattgttccattggttgggctaatgatgaacaatggggtttatactctaaaagtgatgatatgactgttcaatattctgttattggtccatctaattctttctcataccacagtaaaggtattcatggttttgctatcatgcttggtcgtaagaatgtttcataccaccataatttaattgcacacaatgtttctagaaactttagaggtaaggtgccagataagaatgcatgtgattttactaataatgttatctacaattggggttcccaaactacttatggtaccattggtcactt

SEQ ID NO: 26063 - DNA, 231 bp, Neocallimastix californiae
  Pectin lyase-like
ttatttaaccggtaatcgtttccttaatagtaataataccccttataatgatttttctaataataattggaaaggtatcacctataaaaataattccaaaaatgaaggaaatactaaatccaactctccattcgttatgaataatggaagtgataattcttcaacaattgctcatgttgaatctgcagaaaaagcttatgataatgttttagctcatgctggtaatggtat

SEQ ID NO: 26064 - DNA, 276 bp, Neocallimastix californiae
  Pectin lyase-like
tgatttctatgttgccactaatggtgatgattcaaatccaggtaccaaagatgctccatttgcatctcttgataaagcacgtcaagctgtaagaaatgtttccaaaactaaaaatattattgtagaaattgctgatggtttctatccagtagataaaactattaaatttacttcagaagattctggtaataatagatctacaattttatatagagcagctcaaggagctaaaccagttataagtggtggtgaattaatcactggtacatggactaa

SEQ ID NO: 26065 - DNA, 144 bp, Anaeromyces robustus
  Pectin lyase-like
caagaataatcatgttaattataatagagttgaagaaatttgttcacttctttcagatgctggaggtatttatactcttggtaaacaaggtaattcagattggagtgaatattctgaaatgagttataattatattaattgtaa

SEQ ID NO: 26066 - DNA, 420 bp, Anaeromyces robustus
  Pectin lyase-like
ttctgctatttacattaattcttcaagaaatattaagtttattaatggtgaaataagacatactggtagtcttggtattcatcttgaaaatgatgttaatgatattgatgttactggtaattatattgctaaaactagtggtgctggtattgttattggtcatccaactcatgtttatgaaaatgataccaataatcattctgttggttatgactttgcaggtccagataaggaaaagtttaagagaggtaccgaatccgttccaaagaatatttccgttactaataattatttacttgaaaattgttattccttctcaggtcattccccaatcacatccttctatacctataatcttcaagttcttcataactttatttataaatgttcttacagtggtatgagtattggttggggttg

SEQ ID NO: 26067 - DNA, 72 bp, Anaeromyces robustus
  Pectin lyase-like
aggtaataccccacttagtagttatgttcaaaatattatatttgatggaattacctttgcctattccgattg

SEQ ID NO: 26068 - DNA, 273 bp, Anaeromyces robustus
  Pectin lyase-like
tgatttctatgttgccactaatggtgatgattcaaatccaggtaccaaagatgctccatttgcatctcttgataaagcacgtcaagctgtaagaaatgtttccaaaactaaaaatattattgtagaaattgctgatggtttctatccagtagataaaactattaaatttacttcagaagattctggtaataatagatctacaattttatatagagcagctcaaggagctaaaccagttataagtggtggtgaattaatcactggtacatggac

SEQ ID NO: 26069 - DNA, 684 bp, Anaeromyces robustus
  Pectin lyase-like
ttcaaagccagttgcttttccaggcgctgatggtggtggtaaatttgccactggtggtcgtggcggtgaagtaatttatgtcacaaatttaaatgatagtggagctggttcatttagagatgctgttagtaaaccaaatcgtattgtagtatttaaagtctctggtactattgaattgaaaagtgatgttgttgtaaaaagtaatattactattgctggtcaaacagctcctggaggtcatggtgttgttttaaagaattttaagcttggttttggtggaactaatgttatatgtcgttttattggttctagaccaggtgaaagaggttctaatgctgattatgatgcttggggtggtgctgaaggttcaaatactattgttgatcactgctctattggatgggcaaatgatgaacagtggggtttatattccaagagtgatgatttaaccgttcaatactctgtcatcggtccatctaattctttttcttaccatagtaaaggtattcatggttttggtattatgcttggacgtaaaaatgtatcttaccatcacaatttaattgctcataatgtttccagaaattttagaggtaaagttccagataaaaatacttgtgatttcactaataatgtcatatataattggggatcccaaactacatatggtactattggtcactt

SEQ ID NO: 26070 - DNA, 234 bp, Anaeromyces robustus
  Pectin lyase-like
atatttaacaggtaatagattccttaatagtaataatacaccatataatgacttttctgctaataattggagaggtattacttataaaaataattcaaagaatgaaggtaatactaaatctaatacaccatttgctatgactaatggtagtgataattcatctactattgcaaaggttgaaccggctgaacaagcttataataatgtattagcttatgctggtaatggtatcac

SEQ ID NO: 26071 - DNA, 324 bp, Neocallimastix californiae
  Pectin_lyas_fold
tgatttctatgtatcagttgatggtagtgattcaaatgatggatctaaggatagtccatttgcaactcttgataaggcacgtcaagcagtaagaggcctttcaaagacaaagaatattgttgttgaaattgctgatggtttctatcctgttgataaaactatcaagtttacatcagaagattctggtaataacaaatcaacaatttattataagagtgctaaaggtgctcatccaattattagtggtggtgaaaagattactggttcatggactagagctactgaagtcaattggcttcgtaatggacttacagcttacaagac

SEQ ID NO: 26072 - DNA, 810 bp, Neocallimastix californiae
  Pectin_lyas_fold
agctttcggtcaagaagatcaacacaacgatatttaccgtacttatgatgttccagtatctgcaatttacattaattcttcaagaaacgttaaattccttaacggtgaaataagacatactggtagtattggtatgcatcttgaaaatgatgtcaatgatatagaagttactggtaattacattgctaagactagtggtgcaggtattgttattggtcatccaacacatgtatatgaaaatgataataatagacattcagttggttccaactttgctggtccagacaaggaaaagttcaaaaatggtaccgaatctgttcccaagaatatttcagttactaacaattacttacttgaaaactgttattccttctccggtcactcaccaattacttcattctatacttataatcttcaagttcttcacaactttgtctacaaatgttcttacagtggtatgagtattggttggggttggtgtgaatttgatggttttgatggaagatctctctatgatatgaacgccaaccaatttgatggttatagtaaaggtccagcaagaattgttggtgttccaactgaaacttcaaagaataatcacattaattataatagagttgaagaaatttgttcacttctttctgatgctggaggtatttacactctcggtaagcaaggtaatcaagattggactgaatactctgaaatgagttacaattacatcaattgtaaacgtaatggtcaacaagctgatggtagtagaagagttaacggtttccatcctgatgaaggaagtgcttacattaagtt

SEQ ID NO: 26073 - DNA, 243 bp, Neocallimastix californiae
  Pectin_lyas_fold
aaattatttgatttatttaaccggtaatcgtttccttaatagtaataataccccttataatgatttttctaataataattggaaaggtatcacctataaaaataattccaaaaatgaaggaaatactaaatccaactctccattcgttatgaataatggaagtgataattcttcaacaattgctcatgttgaatctgcagaaaaagcttatgataatgttttagctcatgctggtaatggtat

SEQ ID NO: 26074 - DNA, 660 bp, Neocallimastix californiae
  Pectin_lyas_fold
cttccctggtgctgatggtggaggtaaatttgctactggaggtcgtggtggtgaagtttattatgtaactaatttaaatgatagtggtgctggttcatttagagatgcagtcagtagatcaaatcgtattgttgtttttaaggttagtggtaccattgaattaaaaagtgatgttgttgttaaaggtaatataactgttgcaggtcaaacagctccaggtggtcatggtgtcgttttaaagaatttcaaaattggtttaggtggaacaaatattattcttcgtttcattggatcaagaccaggtgaaagaggctcgaatgcagattatgatgcttttggtggggctgaaggaagcaacagtattgtagatcattgttccattggttgggctaatgatgaacaatggggtttatactctaaaagtgatgatatgactgttcaatattctgttattggtccatctaattctttctcataccacagtaaaggtattcatggttttgctatcatgcttggtcgtaagaatgtttcataccaccataatttaattgcacacaatgtttctagaaactttagaggtaaggtgccagataagaatgcatgtgattttactaataatgttatctacaattggggttcccaaactacttatggtaccat

SEQ ID NO: 26075 - DNA, 273 bp, Neocallimastix californiae
  Pectin_lyas_fold
agctgatttctatgttgccactaatggtgatgattcaaatccaggtaccaaagatgctccatttgcatctcttgataaagcacgtcaagctgtaagaaatgtttccaaaactaaaaatattattgtagaaattgctgatggtttctatccagtagataaaactattaaatttacttcagaagattctggtaataatagatctacaattttatatagagcagctcaaggagctaaaccagttataagtggtggtgaattaatcactggtacatg

SEQ ID NO: 26076 - DNA, 327 bp, Anaeromyces robustus
  Pectin_lyas_fold
agctgatttctatgttgccactaatggtgatgattcaaatccaggtaccaaagatgctccatttgcatctcttgataaagcacgtcaagctgtaagaaatgtttccaaaactaaaaatattattgtagaaattgctgatggtttctatccagtagataaaactattaaatttacttcagaagattctggtaataatagatctacaattttatatagagcagctcaaggagctaaaccagttataagtggtggtgaattaatcactggtacatggactaaagctacagaagttaattggcttcgtaatggacttacagcttataaaac

SEQ ID NO: 26077 - DNA, 615 bp, Anaeromyces robustus
  Pectin_lyas_fold
gagaggtaataccccacttagtagttatgttcaaaatattatatttgatggaattacctttgcctattccgattggaatctttacgaacttaatgataatggtaaactttctcatggttatgcttctgtacaaggtgctattgttatggctgcctttggtcaagaagatcaacataatgatatttatcgtacttatgatgtacccgtttctgctatttacattaattcttcaagaaatattaagtttattaatggtgaaataagacatactggtagtcttggtattcatcttgaaaatgatgttaatgatattgatgttactggtaattatattgctaaaactagtggtgctggtattgttattggtcatccaactcatgtttatgaaaatgataccaataatcattctgttggttatgactttgcaggtccagataaggaaaagtttaagagaggtaccgaatccgttccaaagaatatttccgttactaataattatttacttgaaaattgttattccttctcaggtcattccccaatcacatccttctatacctataatcttcaagttcttcataactttatttataaatgttcttacagtggtatgagtat

SEQ ID NO: 26078 - DNA, 243 bp, Anaeromyces robustus
  Pectin_lyas_fold
aaattattccatatatttaacaggtaatagattccttaatagtaataatacaccatataatgacttttctgctaataattggagaggtattacttataaaaataattcaaagaatgaaggtaatactaaatctaatacaccatttgctatgactaatggtagtgataattcatctactattgcaaaggttgaaccggctgaacaagcttataataatgtattagcttatgctggtaatggtat

SEQ ID NO: 26079 - DNA, 660 bp, Anaeromyces robustus
  Pectin_lyas_fold
ttttccaggcgctgatggtggtggtaaatttgccactggtggtcgtggcggtgaagtaatttatgtcacaaatttaaatgatagtggagctggttcatttagagatgctgttagtaaaccaaatcgtattgtagtatttaaagtctctggtactattgaattgaaaagtgatgttgttgtaaaaagtaatattactattgctggtcaaacagctcctggaggtcatggtgttgttttaaagaattttaagcttggttttggtggaactaatgttatatgtcgttttattggttctagaccaggtgaaagaggttctaatgctgattatgatgcttggggtggtgctgaaggttcaaatactattgttgatcactgctctattggatgggcaaatgatgaacagtggggtttatattccaagagtgatgatttaaccgttcaatactctgtcatcggtccatctaattctttttcttaccatagtaaaggtattcatggttttggtattatgcttggacgtaaaaatgtatcttaccatcacaatttaattgctcataatgtttccagaaattttagaggtaaagttccagataaaaatacttgtgatttcactaataatgtcatatataattggggatcccaaactacatatggtactat

SEQ ID NO: 26080 - DNA, 876 bp, Neocallimastix californiae
  Peptidase_S8
ttatattttagatagtggtatatatggtgaccatattgattttgataccggtcatcgtacggtgtcctgtgatgcgatgtttggtaaaactcgtgtcatcaatcaacctggctcttctaattataaaaattgttatctagaaaacgaacttaaattccatggttctatggtagcttcggtagctgcgggaaaatattttggtgtagcgaagaatgctaatattcatatgatagttcatgatcgtaccgctttaaatattctttatgcctatgattatgttaaaaaatatgccaaaaatcctcataaaacggtcattaatctttcctttggtaattatattcgtatacctgaagaagaaaaaatgattaattctttagctgaaatgggatttatagtgattgctgccgccggtaatgattatacgaatgcttgtaccaataatcctcgacaagtaaaacaagagggtcaaacagttaccgtcaccagtaaaatgtatcctgcagcgtatagtaacgtcatcgctgttggggccaccaataatgatattcaatcattagatgtgaccaacgttagtaatctttataatgttgcctctttcagtaactatggaaattgtcttgatatttttggtcctggttatgtctatggagcctatcctggatatgattatagaaataacaactctatacaagcttacgctggcggtacctcattttcttgtccaatagtggctggtgtggccgcttctataatttcagaacatcctgaaattgaatttaacgttactattttaagacagtggctattggataatgcagttcggaatattattggtaattcaagtcaatttgatagtccagatattttcttaaataa

SEQ ID NO: 26081 - DNA, 255 bp, Neocallimastix californiae
  Peptidase_S8
taacaactctatacaagcttacgctggcggtacctcattttcttgtccaatagtggctggtgtggccgcttctataatttcagaacatcctgaaattgaatttaacgttactattttaagacagtggctattggataatgcagttcggaatattattggtaattcaagtcaatttgatagtccagatattttcttaaataatggtaagaaaacggtttattctgctaatggtcaatataatggttgtggtattct

SEQ ID NO: 26082 - DNA, 858 bp, Neocallimastix californiae
  Peptidase_S8
atatattttagatagtggaatcgatgttcatcatgctgattttgaattggatactggtaatactggtaacggttatcgtaccgtgtcttgtgatgctatgtttggtgataaagaaattattaatcaacctggttcctcaagctacaaaaattgcttcttagaagagaaaataaaataccatgggagcatggtagcttcaatcgctgctggtaaaattcatggggtcgctaaaaatgctaatattcatatggtggtgcataaccgacagagtaccggtattctgttggcctataattttgttaaaaacaatcttaaagatcctcataagacggttattaacctatcatttggcagttataaaaaaattccagaagaggtatcattaattaattcgttaattgaaatgggatgtatcgtggttgcagctgggggtaatgataacatcagcagttgtaccacggaacctagatatgttgtttcggatgacgataataaggtaaaaaccctaatacaggaaaagatttatcctgcttctctggaaaatgtcattggcgttggatcaatacgtaacaaaattaaagaaacggatgtttcaagtgttcagaacttgtatagccttgctgattttagtaattatggggattgccttgatctatttgctcctggttatgcctatgccgcctatccaccacccaataataacgataaaagttcttctgatttggaaggctacggcgggggttcctctttttctgcaccccttgtcgcaggggtggcagcctctataatttcagaacatccagaaatgacatttaatcattccctaatgaaaaaaatgcttctggaaatttctgtgga

SEQ ID NO: 26083 - DNA, 663 bp, Anaeromyces robustus
  Peptidase_S8
agctcatccttatgaaggtgaagataaaaagaaatgtaaatttgctgaagatagttatccaggtcatggtaatatggtttcttccttagcaggaggaaaattatacggtgcagcaaaaaaggcaaatttacatatgattgtttcttattatgaattatatgaaactattgtagcattagattatatcaaacaaaatggtaaaccttatcaatccattattagtttttctcgaggagcttataaaaaatatagtcaatttttacaagataaattagatgaattaaatgatgcaggatttattactgttgttgctgctggtaatgaaacggaagatatatgtcatgaaaaaaataaatatttttattctatagcaggctataaaaatgtaattattgtaggttcaacagaatcaacttacaataatgatattgaaaatggttataaaattgcttcttactcaaattatggggaatgtattgatatttttgctccaggtcaagccagatatgcaaattatcaattaaatagaaaagcacaaggtacttcagtatctacagcgattacagcaggagttatagctactattatgtccgaacatcctgacattaaatttaatgtagatactatgaaagaaaaattatttgaattatcattaaaaaatat

SEQ ID NO: 26084 - DNA, 84 bp, Neocallimastix californiae
  Peptidase_S8/S53_dom
ggaagaattatataatatcataaaggatttaccagatgtcgtatcctgtaatgaagatgtcgtcattcctttccccaatgatac

SEQ ID NO: 26085 - DNA, 957 bp, Neocallimastix californiae
  Peptidase_S8/S53_dom
tgttactgtctttgaaaatacttatcatcatttatcgcttatttctcaatctaaatatgatagaaatttagttggaaaatatgatcgaaacttttattatccaatctctgctggtagaggagtggatatttatattttagatagtggtatatatggtgaccatattgattttgataccggtcatcgtacggtgtcctgtgatgcgatgtttggtaaaactcgtgtcatcaatcaacctggctcttctaattataaaaattgttatctagaaaacgaacttaaattccatggttctatggtagcttcggtagctgcgggaaaatattttggtgtagcgaagaatgctaatattcatatgatagttcatgatcgtaccgctttaaatattctttatgcctatgattatgttaaaaaatatgccaaaaatcctcataaaacggtcattaatctttcctttggtaattatattcgtatacctgaagaagaaaaaatgattaattctttagctgaaatgggatttatagtgattgctgccgccggtaatgattatacgaatgcttgtaccaataatcctcgacaagtaaaacaagagggtcaaacagttaccgtcaccagtaaaatgtatcctgcagcgtatagtaacgtcatcgctgttggggccaccaataatgatattcaatcattagatgtgaccaacgttagtaatctttataatgttgcctctttcagtaactatggaaattgtcttgatatttttggtcctggttatgtctatggagcctatcctggatatgattatagaaataacaactctatacaagcttacgctggcggtacctcattttcttgtccaatagtggctggtgtggccgcttctataatttcagaacatcctgaaattgaatttaacgttactattttaagacagtggctattggataatgcagttcggaatat

SEQ ID NO: 26086 - DNA, 186 bp, Neocallimastix californiae
  Peptidase_S8/S53_dom
ctatggagcctatcctggatatgattatagaaataacaactctatacaagcttacgctggcggtacctcattttcttgtccaatagtggctggtgtggccgcttctataatttcagaacatcctgaaattgaatttaacgttactattttaagacagtggctattggataatgcagttcggaatat

SEQ ID NO: 26087 - DNA, 972 bp, Neocallimastix californiae
  Peptidase_S8/S53_dom
tgaaaacacgtacaatcatttatcacttatttctcaatcaaaatttgataaaaatttaattggacaatatgattcaaactattactatccttcttctgcaggtaaaggagtggatatatatattttagatagtggaatcgatgttcatcatgctgattttgaattggatactggtaatactggtaacggttatcgtaccgtgtcttgtgatgctatgtttggtgataaagaaattattaatcaacctggttcctcaagctacaaaaattgcttcttagaagagaaaataaaataccatgggagcatggtagcttcaatcgctgctggtaaaattcatggggtcgctaaaaatgctaatattcatatggtggtgcataaccgacagagtaccggtattctgttggcctataattttgttaaaaacaatcttaaagatcctcataagacggttattaacctatcatttggcagttataaaaaaattccagaagaggtatcattaattaattcgttaattgaaatgggatgtatcgtggttgcagctgggggtaatgataacatcagcagttgtaccacggaacctagatatgttgtttcggatgacgataataaggtaaaaaccctaatacaggaaaagatttatcctgcttctctggaaaatgtcattggcgttggatcaatacgtaacaaaattaaagaaacggatgtttcaagtgttcagaacttgtatagccttgctgattttagtaattatggggattgccttgatctatttgctcctggttatgcctatgccgcctatccaccacccaataataacgataaaagttcttctgatttggaaggctacggcgggggttcctctttttctgcaccccttgtcgcaggggtggcagcctctataatttcagaacatccagaaatgacatttaatcattccctaatgaaaaaaatgcttctggaaatttctgt

SEQ ID NO: 26088 - DNA, 84 bp, Neocallimastix californiae
  Peptidase_S8/S53_dom
tgaagagttatatgaaattattaaggagttaccagatgtggtgtcttgcaatgaaaatgtcataattcctttccccaatgataa

SEQ ID NO: 26089 - DNA, 846 bp, Anaeromyces robustus
  Peptidase_S8/S53_dom
taattattattatccttcttctgcaggaaaaggtattgatatatttttaatagataaaggactttatttagataatgatgattttgatagatatgaaggaacagaggatgaacgtacattaacgtgtgatgctttagttgtttatggtgtagctcatccttatgaaggtgaagataaaaagaaatgtaaatttgctgaagatagttatccaggtcatggtaatatggtttcttccttagcaggaggaaaattatacggtgcagcaaaaaaggcaaatttacatatgattgtttcttattatgaattatatgaaactattgtagcattagattatatcaaacaaaatggtaaaccttatcaatccattattagtttttctcgaggagcttataaaaaatatagtcaatttttacaagataaattagatgaattaaatgatgcaggatttattactgttgttgctgctggtaatgaaacggaagatatatgtcatgaaaaaaataaatatttttattctatagcaggctataaaaatgtaattattgtaggttcaacagaatcaacttacaataatgatattgaaaatggttataaaattgcttcttactcaaattatggggaatgtattgatatttttgctccaggtcaagccagatatgcaaattatcaattaaatagaaaagcacaaggtacttcagtatctacagcgattacagcaggagttatagctactattatgtccgaacatcctgacattaaatttaatgtagatactatgaaagaaaaattatttgaattatcattaaaaaatattattagtggattaaataatgttacaccaaatag

SEQ ID NO: 26090 - DNA, 2121 bp, Neocallimastix californiae
  PERIPLASMIC BETA-GLUCOSIDASE-RELATED
gtcagaatctgaagacttagctaaagctttagttgaagaaatgactttagatgaaaagattggaatggttactggttctcaaaatagttttggtccatgtgttggatatattgaaccaattgaaagattaggtttcaagggtatgtgtttccaagatggtccagctggtgttcgtagtgctaaacatactacaactttaccatctggtttaaatattgcttctacttttgatccagaaattatgaagaaaattggtgttgtattaggtgaagaatcaagagctaagggtgttaatgccattttaggtccagctatgaatatgtaccgttctccagctgctggtagaaattgggaaggttatggtgaagatacctatcttgcttcagttgcttcaaagaatgttgtagctggtattgctagtcaaggtgtccttgctactattaagcactttgctggtaatgagcaagaaactaaccgtgaaacatctaattctgagattgatgaacgtgttttacaagaagtttacttcccaccattcaaggctggaattgtttctggtgctggtggtgttatggctgcttacaacgaccttaatggtattccatctgctaataatacctggcttttaaacaaagttttaaagaaacaaatgttattccatggtttcgttaccagtgactggtggggtactaaggataagtacgaaattatgaatggtttagatattaatatgccaggtggtaaacaatggggtccaaccgtaactgaaagttactggggtgaagaacttaaggaagctgttgaatctggtgaaattgatgtctcttatgttgatgaagcttgtactcgtatcttaactatgttatacaagtacagacaatttgatgactatccagaaattaatcttgatgctgatgctacagaaggtcatgcagaagttgttcgtgaagctgctgctgctagtgttgttcttttaaagaatgatgaagatattttaccaatttctggtgacaagtacaaaaagattgctatcatcggtgatggtgctcttccaactaagcaatgtactgataatggttgttccgaaggtaagatgtctggtgttgttgctttaggttggggttccggtactaccaacatggaaaacataagtgatccactttctgctcttactgaacgtgctgaaaaggatggtattactatcactagcttcactgatgatgatagtgatacagataaggctgccgaagttgctgctgatgctgatctcgctattgttgttgtagttgctgattctggtgaagagtacattagtgttgaaggtaataagggtgacagaaagaaccttgatttatggcataatggtaatgaattagtttctgctgttgctgctgctaacaagaacactgttgttgttatttactctccaggtgttgttaatttacctttcattgatgaagttaatggtttagtttatgctggtatgccaggtcaagaagctggtcacggtcttgctgatattttatttaatgatgttgctccatctggtaagttaccatttacttggggtaagaaacgtgaagattactgttgtgacgttgttacaggcggtaaaggaaaaactcaagttccatacgaagaaggttattacattggttacaaatggttcgataagaaaaacattgaaccacacttctcctttggtcatggtcttacctatgctaagttcaagattcatgatgatggtcaaagttactggaacgttcaaactcaacgtctcttaaaccttatcaatggtatttctactacatttactattgaaaacactagtgatttcgatggttacgttactccacaagcttatcttactatgccttctccaaaggatgatccacgtattggtgaatacccagaattccaattaaagggatttgaaaagtatttcttaaaggctggtgaaaagagaaaagtaaaccttcttgttccatacgccgaaaccaaatactttaacactactactaacacttgggaaactactattgatggtaaatacaaggtttccattggtctttctcatgatgatatttatattagaaatgaaattgaaaactacaacaaatc

SEQ ID NO: 26091 - DNA, 2097 bp, Neocallimastix californiae
  PERIPLASMIC BETA-GLUCOSIDASE-RELATED
tacttgggaagaagcagaccaaaaggcaaagacctttatgagcgatttaactgaaagtgaaaaaattgatattgtcactggttatatgaataatcaaggttcatgtgttggtaatgttaaaccactcagcagaaagaatttcaaaggtatatgtttacaggatggtccagcaggtgttcgttttaatgatggaacttcaactacatggcaagttggtattaataatgctgccacttttaataaggaattattatacaaaattggtaaggaccaaggtgctgaattcaaggctaagggtattaatattgctcttgctccatctatgaatattcttcgtgctccagcttctggaagagtttgggaaaactttggtgaagatccatatttatctggtgtttgtggtactgaaatgactaagggttaccaagattctggttgtattgtttccgcaaagcattatgttgctaatgatgttgaacacaatcgtgaagcttcaacttctaatatggatgaacaaactttaatggaaattcatgttgaaccattctatagaactgttactgaaggtcaagctggttctgtcatggcctcctacaacgctgttaatgatgtatatgttgttcaaaataagaaggtgcttactgaaattttaaaggaaaaaatgaatttccaaggttttgttatgtctgattggtgggctattcatgatttagaaggtagtttcaatgctggtgttgatttgaatatgccaggtggtaaagcttggggtccagattatattaatgattctttctggggtaacaatatttctactgctatcagaaatggaaaggtatcttcagctcgtttggatgatgctgttagacgtattattcgtacattatacagattcgatcaaatgagtggttatccaaatgttaacatcagagcacaaagtatgcatgctgaaactaatagacaagctgctattgaaagtactgttttattaaagaatgctgattctattttaccattaactaacaaatataagaagattgctattattggtaaggatgctgataaagctcagaaatgtaatgattcagcatgtactaatggtaatattattcaaggatggggttcaggtactactgatttcgttggtgtttctgatccatttagtgcgattaaaaacagagcttctaaagatggtatttctgttgtaagttcactttctgataattctagtgaaggtgctaatgccgcaagaggagctgatgttgctcttgttttcgttagagcttcttctggtgaagaatacattgttgtcgataataacaaaggtgatcgtaacaacttagatttatggcatggaggtaatgatttagtaaagagtgttgctgctgttaataagaataccattgtcgttattcatgctccagctactgttaaccttccattccttgataatgttaaggctgttattcatgctggtatgccaggtgctgaatctggtaatgctattgcctctattttattcggagattctaacccatctggtcatcttccatttacttgggctccaagagaagattactgttgtgatgtttcttatccaggagaacttccaaaaggtggaaactccaagactgtatatgactataaggaaggattattcgttggttaccgttggttcgataaaaagggaattgttccaaccttcccattcggtcatggtctttcttacactacttttgattactctaacctttccgtttcccttcaaaagagtggtaccgatgttactggaattaaggctaccttcgatgttaagaatagtggttctgttgaaggtgctactgttccaatgcttttccttggttacccagaagtttctgaacttaagaattacccaattcgtggtttaaaggcattcgataagattaacttaaaggctggtgaaaagaaaactgttactcttactgttgatcaacatggattatcatactacaacacttctcagggtaagtttgttgttccaagcggtggtgaatacactgtctatgttggtaagagtgctggtgatcttccacttaagcttgctattaagaatactca

SEQ ID NO: 26092 - DNA, 2121 bp, Neocallimastix californiae
  PERIPLASMIC BETA-GLUCOSIDASE-RELATED
gtcagaatctgaagatttagctaaggcttttgttgaaaaaatgactttagatgaaaagattggaatgataactggttctaaaaacagttttggtccatgtgttggttatattgaaccaattgaaagattagacttcaaaggtatgtgcttacaagatggtccagctggtgttcgtaatgctaatcatagtactactttcccctcaggtttaaatattgcttcaacatttgatccagaaattatgaagaaacttggtgttgctttaggtgaagaatgtagagccaagggtgttaatgcacttttaggtccagctatgaacatgtaccgttctccagctgctggtagaaattgggaaggttatggtgaagatacttaccttgcttcagttacttctaaaaatgttgttgctggtgttgttagtcaaggtgtacttgctacagttaaacactttgccggtaatgaacaagaaacaagacgtgaacattctaactcagttgttgatgaacgtgtcttacaagaagtatatttcccaccattcaaagctgctattgtttctggtgctggtggtgttatggcagcttacaatgacctcaatggaattccagctgccaacaatacttggcttttaaataaagtcttaaagaagcaaatgatgttccacggttttgtcaccagtgattggtggggtactaaggataagtatgaaattatgaatggtttagatattaatatgccaggcggtactgactggggtgaatcagttactgaaagttactggggtgaagaacttaaggcctctgttgagtctggtgaaatagatgtttcatatgttgatgatgcttgcgtacgtataatgaccatgttatacaagtacagacaatttgatgactatccagaaattaatcttgacgctgatgctactgaaggtcatgctgagattgctcgtgaagctgctgctgccagtgttgttcttttaaaaaatgatgaagaaattttaccaatttctgctgataaatacaagaaaattgctattattggtaacggtgctcttccaacagaagtttgtactgataatggttgtaaaagtcaaatatctggtgtagtcgcgttaggttggggttctggtacaacaaacatggaaaacattagtgacccactttcagctcttactgaacgtgctgaaaaggatggtatcactattactagtttcacagaagatgatagtgatactgaaaaggctgccgaagttgctgctgatgctgatcttgcaattgttgttgttgtcgctgattccggtgaaggatacttaactgttgaaggtaacagtggtgatagaaaagatcttgatttatggcacaatggtaatgatttagttgctgccgtagctgctgcaaataaaaatactgttgttgttatctactctcctggtgttgttaatttaccattccttgatgatatcaatggtttagtttatgctggtatgccaggtcaagaagctggtcatggtcttgctgatgttttattcaatgatgtagcaccatctggtaaactaccattcacctggggtaagaagcgcgaagattactgttgcgatattgttccaggtagaggaaatgaaattacccaagttaaatataccgaaggttactacattggttacaaatggtttgataaagaaaagattgaaccacacttctcatttggtcatggtcttacttatgctaagtttaagattcatgatgatggtcaaagttactggaatgttcaaacccaacgtctattaaatcttattaatggtatttctactactttcactattgaaaatactagtgaatttgatggttatgtcactccacaagcctatcttacaatgccatctgcaaaggatgatccacgtattggtgaatacccagaattccagtttaagggatttgataagattttcttaaaggctggtgaaaagaaaaagattaatcttcttgttccatatgctgaaactaaatatttcaatactactaccaacacttgggaaactactatcgatggtaaatacaaggtttctattggtttatcacatgatgatatctatattcgtaatgaagttgaaaattacaataaatc

SEQ ID NO: 26093 - DNA, 2073 bp, Neocallimastix californiae
  PERIPLASMIC BETA-GLUCOSIDASE-RELATED
agatgaaaaaattaatatggtcactggttcccaaaatagtttcggaccttgtgttggttatcttgaaccaattgaaagattaggtttcaagggtctctgtttacaagatggtccagctggtgtacgttctgctaaacacagtactactttcccatctggtttaaatattgcctctacatttgacccagaactcatgaaaagtcttggtgttgctttaggtgaagaagtcagagctaagggtgtcaatgctatcttaggtccagctatgaacatgtaccgttctccagttggtggtagaaattgggaaggttatggtgaagatacttatcttgcttcagtagctgcaaagaatgttgttgctggtattactagtcaaggtgttattgctaccattaaacactttgttggtaatgaacaagaaactaaacgtgaatcatcaaattctattattgatgaacgtgttttacaagaagtttacttcccaccatttaaggctgctattgtttctggtgctggtggtgctatggctgcatacaatgatcttaatggtattccatgtgccaacaatacctggcttttaaacaaagttttaaagaagcaaatgttattccacggtttcgttacaagtgactggtggggtgttaaggataaatacggaattatgaatggtttagatcttaacatgccaggtggtaaggaatggggaccaaccgttaaagatagttactggggtgaagaacttaaggaagctgttgaatctggtgaaattgatgaaatgtaccttgatgaagcttgtattcgtgttatgactatgttatacaagtacagacaattcgatgattacccagaaattaatcttgatgctgatgctactgaaggtcatgctgaaattgttcgtaaagctgctgctaatagtgttgttattttaaagaatgatgatgatgttttaccaatttctccaaagaaatacaagaagattgctattattggtgatggtgctcttccaatgaaactttgtgaagataatggttgtaaggataaaatatctggtgttgttgcattaggttggggttctggtactactaatatggaaaatattagtgatccactttctgcaattactgaacgtgctgaaaaggatggtattaccattactagttttactgaagatgatgacgatactgataaagctgctgaagttgctgctgatgctgatcttgctattgttgtcgttgttgctgattctggtgaaggttacttaactgttgaaggtaacagtggtgacagaaaagatcttgatttatggcacaatggtaatgaattagttgctgctgttgctgctgctaacaagaatacagttgttgttatttactcacctggtgttgttaatttacctttcgttgatgatgttaaaactattctttacgctggtatgccaggtcaagaagctggtcatggtcttgctgatattttattcaatgatgttgctccaactggtaaattaccatttacttggggtaagaaacgtgaagattattgttgtgatgttgttaaaggtaaaggtaattctattactcaagttgaatactctgaaggttattacattggttacaagtggttcgataaacaaaatattaaaccactcttcccattcggtcatggtcttacttacgctaaatttaagattaatgaaaatgctcaatcctactggaatgttcaaactcaacgtcttgttaatcttataaatggtatttctactgttgttactattgaaaatactagtgatattgatggttatgctactttacaagcttatcttaccatgccatctgctgaagatgatccacgtattggtgaatatccagaatatatgcttaaggcttttgaaaaggtattcttaaaggctcatgaaaagaaacaagttaaccttcttgttccatatgctgaaaccaaatatttcaatactactactaatacttggcaagaaactatagatggtaaatacaaggtttctattggtctttctcatgatgatatttacatcagaaatgaaattgaaaacagaaacaaatc

SEQ ID NO: 26094 - DNA, 276 bp, Neocallimastix californiae
  PERIPLASMIC BETA-GLUCOSIDASE-RELATED
tgaaggtgctactgttccaatgcttttccttggttttccaaatgtttctgaaatgggtgattatccagtacgtaatttaaaggctttcgataagattaacttaaaggctggtgaaagtaaaactgttactcttgaagttgatcaacatggtttatcctactacaacactaataaaaagaagtttgttgttccaactggtggtgaatacactgtatatgttggtaaaagtgctggtgatcttccacttaaggttactcttaaaaatactcaaggttc

SEQ ID NO: 26095 - DNA, 2121 bp, Anaeromyces robustus
  PERIPLASMIC BETA-GLUCOSIDASE-RELATED
gtcagaatctgaagatttagctaaagcttttgttgaagaaatgactttagatgaaaaaattaatatggtcactggttcccaaaatagtttcggaccttgtgttggttatcttgaaccaattgaaagattaggtttcaagggtctctgtttacaagatggtccagctggtgtacgttctgctaaacacagtactactttcccatctggtttaaatattgcctctacatttgacccagaactcatgaaaagtcttggtgttgctttaggtgaagaagtcagagctaagggtgtcaatgctatcttaggtccagctatgaacatgtaccgttctccagttggtggtagaaattgggaaggttatggtgaagatacttatcttgcttcagtagctgcaaagaatgttgttgctggtattactagtcaaggtgttattgctaccattaaacactttgttggtaatgaacaagaaactaaacgtgaatcatcaaattctattattgatgaacgtgttttacaagaagtttacttcccaccatttaaggctgctattgtttctggtgctggtggtgctatggctgcatacaatgatcttaatggtattccatgtgccaacaatacctggcttttaaacaaagttttaaagaagcaaatgttattccacggtttcgttacaagtgactggtggggtgttaaggataaatacggaattatgaatggtttagatcttaacatgccaggtggtaaggaatggggaccaaccgttaaagatagttactggggtgaagaacttaaggaagctgttgaatctggtgaaattgatgaaatgtaccttgatgaagcttgtattcgtgttatgactatgttatacaagtacagacaattcgatgattacccagaaattaatcttgatgctgatgctactgaaggtcatgctgaaattgttcgtaaagctgctgctaatagtgttgttattttaaagaatgatgatgatgttttaccaatttctccaaagaaatacaagaagattgctattattggtgatggtgctcttccaatgaaactttgtgaagataatggttgtaaggataaaatatctggtgttgttgcattaggttggggttctggtactactaatatggaaaatattagtgatccactttctgcaattactgaacgtgctgaaaaggatggtattaccattactagttttactgaagatgatgacgatactgataaagctgctgaagttgctgctgatgctgatcttgctattgttgtcgttgttgctgattctggtgaaggttacttaactgttgaaggtaacagtggtgacagaaaagatcttgatttatggcacaatggtaatgaattagttgctgctgttgctgctgctaacaagaatacagttgttgttatttactcacctggtgttgttaatttacctttcgttgatgatgttaaaactattctttacgctggtatgccaggtcaagaagctggtcatggtcttgctgatattttattcaatgatgttgctccaactggtaaattaccatttacttggggtaagaaacgtgaagattattgttgtgatgttgttaaaggtaaaggtaattctattactcaagttgaatactctgaaggttattacattggttacaagtggttcgataaacaaaatattaaaccactcttcccattcggtcatggtcttacttacgctaaatttaagattaatgaaaatgctcaatcctactggaatgttcaaactcaacgtcttgttaatcttataaatggtatttctactgttgttactattgaaaatactagtgatattgatggttatgctactttacaagcttatcttaccatgccatctgctgaagatgatccacgtattggtgaatatccagaatatatgcttaaggcttttgaaaaggtattcttaaaggctcatgaaaagaaacaagttaaccttcttgttccatatgctgaaaccaaatatttcaatactactactaatacttggcaagaaactatagatggtaaatacaaggtttctattggtctttctcatgatgatatttacatcagaaatgaaattgaaaacagaaacaaatc

SEQ ID NO: 26096 - DNA, 2094 bp, Anaeromyces robustus
  PERIPLASMIC BETA-GLUCOSIDASE-RELATED
ttgggaagaagccgataaaaaggcttcatcctttgttagtgatttaagtgaagctgaaaaaattgacattgtaactggttacatgaatatgcaaggtacctgtgttggtaatattaaaccaaatagtagaaaaaattttaagggtttatgtcttcaagatggtccagccggtgttcgttttaatgaaggaacttcaacaacttggcaaactggtattaacagtgcagccacttttaataaggatttattatataaaattggtaaagatcaaggtgccgaattttatgctaaaggtataaacgttgctcttgctccttcaatgaacattcttcgtgccccagcttctggtagagtttgggaaaactttggtgaagatccatatttatcaggtgtatgtggtacacaaattacaaagggtatgcaagattctggtgttattgtttcagctaaacactatgttgctaatgatattgaacataatcgtgaagcttctacatctaacatggatgaacaaaccttaatggaaattcatgtagaaccattctatagaactgtcactgaaggtgaagctggttctgttatggcttcatataatgctgttaatggtgtatatgtggttcaaaataaaaaggtacttactgaaatcttaaaggaaggaatgaacttccaaggtttcattgtttctgattggtgggctattcatgatttagaaggtagtttcaatgctggtgttgatatgaacatgccaggtggtaaggcttggggtccaaattatattaatgattcattctggggttctaacatttctaacgctataagaagtggtaaagttagctccgctcgtttagatgatgctgttaaacgtattattcgttctatgtataagatgaaccaaatgggtaatttcccaaatgtcaatcttagagctcaaagtatgcatactgaaacacacagacaagctgccactgaaagtcaaattttattaaagaacgatgataatgtattaccattaaccaagaaatacagaaagattgctgttattggtaaagatgctgataaagctgaatcttgtaccgatactgcttgtactaatggtaatattattcaaggttttggttctggtactaccgatttcactggtattactgatccatatagctccattaaaaatagagcttcaaaggaaggaataactgttgttggttccatttctgatagtgctaatgaaggtgctaatgctgctagagatgctgatgttgctattgttttcgttagagccacctctggtgaagaatatattgttgttgataataataaaggtgaccgtaataatttagatttatggcatggtggtaatgatttagttaaaagtgttgctgctgttaataagaatactattgtcgttattcatgctccagctactgttaatcttccattcattaacaatgttaaagctattattcatgctggtatgccaggtgctgaatcaggtaatgctatcgcttccgtcttatttggtgatcataatccatctggtcaccttccatttacatgggctaagagagaagaatactgttgtgatgtttcctatccaggagaacttccacatggaggagactcaaagactacttatgattataaggaaggcttattcgttggttaccgttggttcgataaaaagggtactaagccaatttacccattcggtcatggtctttcttacactacctttgaatattctaatctttcttcaagtcttgtaaagagtggtactgaagttactggtcttaaggcaacatttactgtttctaatactggttctgttgaaggtgctactgttccaatgcttttccttggttttccaaatgtttctgaaatgggtgattatccagtacgtaatttaaaggctttcgataagattaacttaaaggctggtgaaagtaaaactgttactcttgaagttgatcaacatggtttatcctactacaacactaataaaaagaagtttgttgttccaactggtggtgaatacactgtatatgttggtaaaagtgctggtgatcttccacttaaggttactcttaaaaatactca

SEQ ID NO: 26097 - DNA, 2121 bp, Anaeromyces robustus
  PERIPLASMIC BETA-GLUCOSIDASE-RELATED
gtctgaatctgaagatttagctaaagaatttgtttcacaaatgactttagatgaaaagattggcatggttacaggttctcaaaacagttttggaccatgtattggttaccttgaaccaattgaaagattaggtttcaagggtttatgtttacaagatggtccagctggtgtacgtagtgctaaacatagtactactttcccatctggtttaaatattgcatctacttttgatgttgaattaatgcatgatcttggtgttgctcttggtgaagaatgtagagcaaagggtgttaatgttattttaggtccagctatgaatatgtatcgttcacctgctgctggtagaaactgggaaggttacggtgaagatacttatcttgcttctgttgcttcaaagaatgttgttgcaggtattcaaagtcaaggtgtacttgctactgctaaacattttgttggtaatgaacaagaatataaacgtgattcttcaaattctattattgatgaacgtgttttacaagaagtttatcttccaccatttaaagcagctgtagtttctggtgctggtgcttttatggcttcttataattctattaatggtattcctgctactaatcatactcaacttttaaataaagttttgaaaaaacaattcttattccatggttttgttactagtgattggtggggtactaaagataaaattgaaattactaatggtttagatatgaatatgccaggtggtaaagtttggggtccaacggtaaaagaaagttattggggtgaagaattaaaagatgctattgaaaatgaagaaattgatatttcttaccttgatgaatcttgtgaacgtattatgactatgttatacaagtataaacaaatggatgatttcccagatcttaatttagatgctgatgctactgaaggtcatactgaactcgtacgtaaagctgctgctgctagtgttgttcttttaaagaatgatgaagatattttaccaatttctcctaaaaaatataaaaaaattgctattattggtgatggtgctcgtccaactaaaccttgtactgataatggttgtgctcaaggtaaaatgtctggtgttgttgttttaggttggggttctggtactactaatatggaaaatattagtgatccactttctgctttaactgaacgtgccgaaaaggatggtattacaattactagttttactgaagatgatagtgatactgataaagctgctgaagttgctgctgatgctgatcttgctattgttgttgttactgcttcttcaggtgaagaatatattactgttgaaggtaatcaaggggatagaaaaaatcttgatttatggcataatggtaatgaattagtttcagctgttgctgctgctaataaaaacacagttgttgttatttattctcctggtgttgttaatttacctttccttgatgatattaaaggtttagtttatgctggtatgccaggtcaagaagctggtcatggtcttgctgatattttatttaatgatgtagctccttctggtaaattaccatttacttggggtaaaaaacgtgaagattattgttgtgatattgtctatggtaatgataaaattattgatattccttactctgaaggtttttaccttggttataaatggtttgataaggaaaaaattgaaccacatttctcattcggtcatggtcttacctatgctaaattcaaaatacatgataatgctcaaagttactggaatattcaaactcaacgtcttgtcaatcttattaatggtatttctactacttttactgttgaaaatactagtgatttcggtggttatattactccagaagtttatcttactatgccatctgaaaaagatgatccacgtattggtcaatatccagaattaaatttcaaaaatttcactaaaatctatcttgaaggaggtgaaaaaagacaagttaatcttcttgttgcttatgcggatactaaatatttcaatatgactactatgaattgggatactactattgatggtaaatatcaaatttctattggtttctcacatgatgatattgttattcatactgaaattgataatcttaataaaac

SEQ ID NO: 26098 - DNA, 2121 bp, Piromyces finnis
  PERIPLASMIC BETA-GLUCOSIDASE-RELATED
gtctgaatcagaagatttagctaaagcttttgttgaagaaatgactttagatgaaaagattaacatggttactggttctgaaaatagttttggtccatgtgttggttacattcctccaattgaaagattaggtttcaaaggtttatgtttacaagatggtccagctggtgttcgttctgctaaacattcaaccactttcccatctggtttaaatattgcttctacttttgatcaaaatcttatgaagaaacttggtgttgctcttggtgaagaatgcagagctaagggtgttaacgttattttaggtccagctatgaacatgtaccgttctccagctgctggtagaaactgggaaggttatggtgaagatactttcctcgctactgttgcttcaaagaatgttgttgctggtattcaaagtcaaggtgtttttgctactgctaagcactttgctggtaatgaacaagaatacaagcgtgaatcttctaactctattattgatgaacgtgttttacaagaagtttacttcccaccatttaaggctgctgttgtttctggtgctggtgcttttatgtcagcttataatgatcttaatggtattccatctgctaacaacacttatcttttaaaccaagttttaaagaagcaatttaaattccacggttttgtcactagtgactggtggggtactaaggataagtatgaaattactaatggtttagatgttaatatgccaggtggtaagcaatggggtccaactgaaaaagaaagttactggggagaagaactcaaggctgctattgaaagcgaagaaattgatatttcttatcttgatgaagcttgtgaacgtattttaactatgatgtacaaatacaagcaaatggatgatttcccagaacttaatcttgatgctgatggtactgaaggtcacactgaacttgttcgtgaagctgctgctgcttctgttgttcttttaaagaacgataaggatattttaccaatttctggtaagaaatacggtaagattgctattattggtgacggtgctcttccaaccaagttatgtactgataatggttgtactcaaggtaagatgtctggtgttgttgctttaggttggggttcaggtactactaatatggaagatattagtgatccactttcagctcttactgaacgtgctgaaaaggatggtattacagttactagttttactgatgatgatgaagatactgaaaaggcagctcaagttgcttctgatgctgatcttgctattgttgttgttactgccaattctggtgaaggttatttaactgttgaaggtaacagtggtgacagaaagaatcttgatttatggcataatggtaatgaattagttgccgcagttgctgcagccaatccaaatactgttgttgttatctattctccaggtgttgttaacttaccatttattgacgatgttgatggtttagtttacgctggtatgccaggtaaggaagctggtcatggtcttgctgatattttattccatgatgtttcaccatctggtaaattaccattcacttggggtaagaagcgcgaagattactgttgtgatgttgtctacggtaatgataaaattattgatgttccatacactgaaggtttctaccttggttacaagtggttcgataaggaaaagattgaaccacacttctcattcggtcacggtcttacttatgctaaattcaagattcacgatgatgctttcagttactggaacattcaaactcaacgtcttcttaaccttattaacggtatttccactactttcactattgaaaacactagtgactttggtggttacattacaccagaagtttatcttaccatgccaactgttgaagctgatccacgtattggtgtttacccagaacttaacttcaagaacttcaccaagatttatcttgaagctggtgaaaagagaaaggttaaccttcttgtagcctatgctgatactcaatacttcaacactaccaagaatgaatggcaaacaactattgatggtacatacaaggttcatgttggtttctcacacgatgatattgtctttaccactgaaattgaaaaccttaacaagac

SEQ ID NO: 26099 - DNA, 2121 bp, Piromyces finnis
  PERIPLASMIC BETA-GLUCOSIDASE-RELATED
gtctgaatcagaagatttagctaaagcttttgttgaagaaatgactttagatgaaaagattaacatggttactggttctgaaaatagttttggtccatgtgttggttacattcctccaattgaaagattaggtttcaaaggtttatgtttacaagatggtccagctggtgttcgttctgctaaacattcaaccactttcccatctggtttaaatattgcttctacttttgatcaaaatcttatgaagaaacttggtgttgctcttggtgaagaatgcagagctaagggtgttaacgttattttaggtccagctatgaacatgtaccgttctccagctgctggtagaaactgggaaggttatggtgaagatactttcctcgctactgttgcttcaaagaatgttgttgctggtattcaaagtcaaggtgtttttgctactgctaagcactttgctggtaatgaacaagaatacaagcgtgaatcttctaactctattattgatgaacgtgttttacaagaagtttacttcccaccatttaaggctgctgttgtttctggtgctggtgcttttatgtcagcttataatgatcttaatggtattccatctgctaacaacacttatcttttaaaccaagttttaaagaagcaatttaaattccacggttttgtcactagtgactggtggggtactaaggataagtatgaaattactaatggtttagatgttaatatgccaggtggtaagcaatggggtccaactgaaaaagaaagttactggggagaagaactcaaggctgctattgaaagcgaagaaattgatatttcttatcttgatgaagcttgtgaacgtattttaactatgatgtacaaatacaagcaaatggatgatttcccagaacttaatcttgatgctgatggtactgaaggtcacactgaacttgttcgtgaagctgctgctgcttctgttgttcttttaaagaacgataaggatattttaccaatttctggtaagaaatacggtaagattgctattattggtgacggtgctcttccaaccaagttatgtactgataatggttgtactcaaggtaagatgtctggtgttgttgctttaggttggggttcaggtactactaatatggaagatattagtgatccactttcagctcttactgaacgtgctgaaaaggatggtattacagttactagttttactgatgatgatgaagatactgaaaaggcagctcaagttgcttctgatgctgatcttgctattgttgttgttactgccaattctggtgaaggttatttaactgttgaaggtaacagtggtgacagaaagaatcttgatttatggcataatggtaatgaattagttgccgcagttgctgcagccaatccaaatactgttgttgttatctattctccaggtgttgttaacttaccatttattgacgatgttgatggtttagtttacgctggtatgccaggtaaggaagctggtcatggtcttgctgatattttattccatgatgtttcaccatctggtaaattaccattcacttggggtaagaagcgcgaagattactgttgtgatattgttagtaacaatgatgtctatccaaagattgaatacagtgaaggtttctaccttggttacaagtggttcgataaggaaaagattgaaccacacttctcattcggtcacggtcttacttatgctaaattcaagattcacgatgatgctttcagttactggaacattcaaactcaacgtcttcttaaccttattaacggtatttccactactttcactattgaaaacactagtgactttggtggttacattacaccagaagtttatcttaccatgccaactgttgaagctgatccacgtattggtgtttacccagaacttaacttcaagaacttcaccaagatttatcttgaagctggtgaaaagagaaaggttaaccttcttgtagcctatgctgatactcaatacttcaacactaccaagaatgaatggcaaacaactattgatggtacatacaaggttcatgttggtttctcacacgatgatattgtctttaccactgaaattgaaaaccttaacaagac

SEQ ID NO: 26100 - DNA, 1068 bp, Neocallimastix californiae; identical to SEQ ID NO: 14461
  PERIPLASMIC BROAD-SPECIFICITY ESTERASE/LIPASE/PROTEASE

SEQ ID NO: 26101 - DNA, 690 bp, Neocallimastix californiae
  PERIPLASMIC BROAD-SPECIFICITY ESTERASE/LIPASE/PROTEASE
tactgttaaaattatgcctgttggtgattctatcacctttggtgaaggtgaaagaggtggatacagaaagtatctttacagtgccttaactcaaaaaggttataaaattgatatggtaggtccggaaggatctaacagtgcttcagctaatggtatacaatatgatgataataatgctggttacagtggattccaaatcaaagaaattccaggctggggtcaacaacaaggtggtgaaggaagtttatataataaacttaagagtaagaatgctgttaagcaatctcaaccagatatcattcttcttatcattggtactaatgatatgactgccaatcgttcaatggatgcttgtgccaatgatcttcgtgctctcttagattatatgcttgcagatatgccagccaatagtattatctttatgggttctattccagaatttactgcttacggtggtaatgctcaaagaattgccaattacaatggtacagttaagaaggttgctgacgaatacgctaataagggtaagaatgttagatttgctgatgttcatggttgtcttaacggtatgtctgatataggtagtgatcgacttcacccaagtggaaatggttacaaaaaaattggtaatttctgggctggagttatcgatgaataccttcaatctattaaaaacgacagcaacaatgg

SEQ ID NO: 26102 - DNA, 684 bp, Neocallimastix californiae
  PERIPLASMIC BROAD-SPECIFICITY ESTERASE/LIPASE/PROTEASE
tgctataaaaattatgcctgttggtgattctattacctttggtatgggagaaaatggaggttatagaaaatatctttatagtgctttaactcaaaaaggttataatattgatatggtaggtccagaaggatcaagtagagctacagctaatggtatttcatatgatgataatcacgctggttatagtggattccaaatcaaggaaattcctgattggggtagacaacaaggtggtgatggtagtttatataataaacttaaaagtaaaaatgctgttaaacaagctcaaccagatattattcttcttattattggtactaatgatatgaccgctaatcgttctatggatgcttgtgcctcagatcttcgtgctcttttagattatatgcttggagatatgccatctggtggtattattttcatgggatctattcctgaatttacagcttatggtggtaatgctcaaagagttgcaaattataatggtactgttaaaaaggttgctgaagaatatgctagtaaaggtaaaaatgttagatttgcagatgttcatggtagtcttaatggtactggtgatcttggtggtgatggacttcaccctaatggaaatggttataaaaaaatgggtaacttttgggcagatgttattgataaatatcttaaagaatctgctccagctccaac

SEQ ID NO: 26103 - DNA, 684 bp, Anaeromyces robustus; identical to SEQ ID NO: 26102
  PERIPLASMIC BROAD-SPECIFICITY ESTERASE/LIPASE/PROTEASE

SEQ ID NO: 26104 - DNA, 1020 bp, Neocallimastix californiae; identical to SEQ ID NO: 22996
  PEROXISOMAL MULTIFUNCTIONAL ENZYME TYPE 2

SEQ ID NO: 26105 - DNA, 1020 bp, Neocallimastix californiae; identical to SEQ ID NO: 22997
  PEROXISOMAL MULTIFUNCTIONAL ENZYME TYPE 2

SEQ ID NO: 26106 - DNA, 1020 bp, Anaeromyces robustus; identical to SEQ ID NO: 22998
  PEROXISOMAL MULTIFUNCTIONAL ENZYME TYPE 2

SEQ ID NO: 26107 - DNA, 1020 bp, Piromyces finnis; identical to SEQ ID NO: 23000
  PEROXISOMAL MULTIFUNCTIONAL ENZYME TYPE 2

SEQ ID NO: 26108 - DNA, 297 bp, Neocallimastix californiae
  PHL pollen allergen
tatctatattagaattcttccaggtgctaaccaatggtatttcgctattaatgtagttaatgttgccaatatgggttctcttgtagctgttgaagtattaagaaatggtaagtgggctccattagttcgtgatccaaattactcttctactagaccacaagaacgttacggttcatgggttgtcccaccattaaaggaaggtgaacaaagtgaaccattcactactccattaactttacgtttcactgattctgctttcaatactcttactgctccagatgctattaaggaatggcc

SEQ ID NO: 26109 - DNA, 282 bp, Neocallimastix californiae
  PHL pollen allergen
cattcatgtctggttacgtccaggtgctggtccatggtactttgctcttaccgttgtcaatgtagctaatatgggttctcttgtcgctgttgaagtccaacaagctgatggtatctgggtaccattagttcgtgatccaaactattcatctactagaccacaagaacgttatggttcctggactgtcaaacaaggtactggtccattctctgttccaatgaatatgcgtttcacagatagtgccttcaacactcttactgctgaaggtgctattaaggattg

SEQ ID NO: 26110 - DNA, 294 bp, Neocallimastix californiae
  PHL pollen allergen
catgtacatttggcttcgtaaagatgctggtccatactggttcgctttctctgttgttaactctgctggtttcggagctattgctgttcttgaagctaagaatgatgaaggtaaatgggttaagatgattcgtgatccaaactacactatgtctcgtccacaagaacgttatggtgtttgggttactccacaagatactggaccatacaaccttccagttgatattcgtttaactgatggttctggtgttactattgttgctgaaaaggctattaagtcctttactccaccagc

SEQ ID NO: 26111 - DNA, 228 bp, Neocallimastix californiae
  PHL pollen allergen
aaaattaaaatggaagatggcttcttcagtatactggggtggtattcaagcttttaatactcgttatccagtcacatctattgaacgttgggatgatgcatctaatgattgggttcatcttagaagggatgatatgtttcattatatgtgggataccactattccaggtggtccaatgaaggtacgtgtaactcaaggtgatggtgttcaagttgttgttgatggctt

SEQ ID NO: 26112 - DNA, 321 bp, Neocallimastix californiae
  PHL pollen allergen
tatgtacatctggcttcgtgaagatgctggtccatactggttcgccttctctgtcgttaactccgctggtttcggtgctattgctgttcttgaagctaagaatgatgaaggtaaatgggttaagatgattcgtgatccaaactacactatgtctcgtccacaagaacgttacggtgtctgggttactccacaagatactggaccatacaaccttccaatcgatattcgtttaactgatggttctggtgtaactgttgttgctgaagaagctattaaatctttcgatccaccagctgatgctattaaaggttactattacat

SEQ ID NO: 26113 - DNA, 285 bp, Neocallimastix californiae
  PHL pollen allergen
cattcacgtttggttacgtccaggtgccggtccatggtactttgctcttactgttgtcaatgttgctaacatgggttctcttgttgccgttgaagtccaacaagctgatggtgtttgggtaccattagttcgtgatccaaattactcttctactagaccacaagaacgttatggttcatggactgtcaaacaaggtactggaccatttactgttccaatgaacatgcgttttactgatagtgctttcaacactcttactgctgaaggtgccattaaagactgggg

SEQ ID NO: 26114 - DNA, 321 bp, Neocallimastix californiae
  PHL pollen allergen
catgtacatctggcttcgtgaagatgccggtccatactggtttgctttctctgtggtgaatagtgcaggttttggtgctattgctgttcttgaagccaagaatgatgaaggtaaatgggttaaaatgatacgtgatccaaattacaccatgtcacgtccacaagaacgttatggtgtctgggttactccacaagataccggaccctacaatcttccaattgatattcgtttaaccgatggttccggagtaactattgtagccgaaaaagccattaaatcctttgatccacctgccgatgccattaaaggatattattacat

SEQ ID NO: 26115 - DNA, 294 bp, Neocallimastix californiae
  PHL pollen allergen
tatgtacatttggcttcgtcaaaatgcctcaccttactggttctcctttactgtagttaattctgctggttttggtggtattgctattcttgaagccaaaaatgatgaaggaaaatgggtaaagttaattcgtgatccaaattacacgatggcacgtccacaagaacgtttcggtacatgggccactccacaagattctggaccatacaatcttccaattgatattcgtttaaccgatggttctggtattacaattgtagcagaagaagccattaaatctttcactccacctgc

SEQ ID NO: 26116 - DNA, 231 bp, Neocallimastix californiae
  PHL pollen allergen
tattaaattccaatttaaatctggtagtacccaattctggggtgaagttcaagttttcaatactcgttacccagtcgctaaagttgaatttttaagtggcggtaagtatgttggcttatacagacgtgcttataattactgggctcttaattctggtggttttggtgcgggtccatacactttccgtgttaccttagctgatagtacagttattgaagctaaaaatgttaa

SEQ ID NO: 26117 - DNA, 297 bp, Neocallimastix californiae
  PHL pollen allergen
catttatattagaattcttccaggtgctaaccaatggtatttcgctatcaatgttgttaacgttgccaatatgggttctcttgttgccgttgaagttttaagaaatggtaaatgggctccattagctcgtgatccaaattattcttctactagaccacaagaacgttatggttcatgggttgttccaccattaaagaagggtgaacaaagtgaaccatttgaaactccattaactttacgtttcactgattctgctttcaatactcttactgctccagatgctattaaggaatggcc

SEQ ID NO: 26118 - DNA, 267 bp, Neocallimastix californiae
  PHL pollen allergen
cattcacgtttggttacgtccaggtgctggtccatggtactttgcccttaccgttgttaatgttgccaatatgggttctcttgtcgctgttgaagtacaacaagaagatggtgtttgggtaccattagttcgtgatccaaattactcttctactagaccacaagaacgttatggttcatggactgtcaaacaaggtactggtccattcactgttccaatgaacatgcgtttcactgatagtgctttcaacactcttactgccaatgg

SEQ ID NO: 26119 - DNA, 297 bp, Anaeromyces robustus; identical to SEQ ID NO: 26117
  PHL pollen allergen

SEQ ID NO: 26120 - DNA, 285 bp, Anaeromyces robustus
  PHL pollen allergen
cattcacgtttggttacgtccaggtgctggtccatggtactttgcccttaccgttgttaatgttgccaatatgggttctcttgtcgctgttgaagtacaacaagaagatggtgtttgggtaccattagttcgtgatccaaattactcttctactagaccacaagaacgttatggttcatggactgtcaaacaaggtactggtccattcactgttccaatgaacatgcgtttcactgatagtgctttcaacactcttactgccaatggtgctattaaagattgggg

SEQ ID NO: 26121 - DNA, 321 bp, Anaeromyces robustus
  PHL pollen allergen
tatgtacatttggcttcgtaaggatgccggtccatactggttctcattctctgttgttaactctgctggttatggtgctattgctgttcttgaagctaaggatgatgaaggtaattggattaagatgcaacgtgatccaaattacactatggctcgtccacaagaacgttatggtgtttgggctactccacaaggtgctggtccattcaatcttccagtcgatattcgtttaactgatggttctggtgtagttgttgttgctgaaaaggctattaaatcattcactccaccagctgattctattgaaggatactactacat

SEQ ID NO: 26122 - DNA, 231 bp, Anaeromyces robustus
  PHL pollen allergen
aattaaattccaatttaaatctggtagtactcaattctggggtgaagtagaagtctttaatactcgttatccagttgctaaagttgaattcttatctaatggtaaatatgaaagtttatacagacgtgcctataattattgggctcttaactctggtggttttggtgctggtccatatactttccgtgttactttagctgatgatactgttattgaagctaaaggagttga

SEQ ID NO: 26123 - DNA, 276 bp, Piromyces finnis
  PHL pollen allergen
cattcacgtctggttacgtccaggtgccggtcaatggtactttgctcttaccgttgtcaatgttgctaacatgggttctcttgttgccgtagaagtccaacaatctgatggtcaatgggttccattagttcgtgatccaaactactctactactagaccacaagaacgttacggttcatggactgtcaagcaaggtactggtccattcaccactccaatgaacatgcgtttcactgattctgctttcaacactcttactgctgaaggtgctatcca

SEQ ID NO: 26124 - DNA, 252 bp, Piromyces finnis
  PHL pollen allergen
attaaagttccaatttaaatctggttctacacaattctggggtgaagttgaagtatttaacactcgttacccagttgcaaaggttgaacttttattaaatggtaaatatcaaagtttatacagacgtgcttataattactgggctcttagttctggtggttttggtgcaggtccatacaccttccgtgttacattagccgataacactgtcattcaagcaacaaatgttgaaatggttattccagcaaatga

SEQ ID NO: 26125 - DNA, 48 bp, Neocallimastix californiae
  PHOSPHOPANTETHEINE
attaggtattgattccattatgatgatggaattacgtaccattttaaa

SEQ ID NO: 26126 - DNA, 48 bp, Neocallimastix californiae
  PHOSPHOPANTETHEINE
attaggtattgattctattatgatgatggaacttcgtcaaattattaa

SEQ ID NO: 26127 - DNA, 48 bp, Neocallimastix californiae
  PHOSPHOPANTETHEINE
gtatggtatcgattctttaactactgtcaagctaactaaccttctctc

SEQ ID NO: 26128 - DNA, 48 bp, Neocallimastix californiae
  PHOSPHOPANTETHEINE
ctcaggatttaactccattaattccgtaaagttaataaaattattaaa

SEQ ID NO: 26129 - DNA, 48 bp, Neocallimastix californiae; identical to SEQ ID NO: 26128
  PHOSPHOPANTETHEINE

SEQ ID NO: 26130 - DNA, 48 bp, Neocallimastix californiae
  PHOSPHOPANTETHEINE
ctcaggattcaactcaatcaattcagttaagctaataaaactattaaa

SEQ ID NO: 26131 - DNA, 48 bp, Anaeromyces robustus
  PHOSPHOPANTETHEINE
attaggtattgattctattatgatgatggaattacgtactattttaag

SEQ ID NO: 26132 - DNA, 48 bp, Anaeromyces robustus
  PHOSPHOPANTETHEINE
attaggaggtgatagtttaaacgctataagaattatatcaatgattga

SEQ ID NO: 26133 - DNA, 48 bp, Anaeromyces robustus
  PHOSPHOPANTETHEINE
atttggattaaattcaattaattccattaaattaattaaattattaaa

SEQ ID NO: 26134 - DNA, 48 bp, Piromyces finnis
  PHOSPHOPANTETHEINE
attaggtattgactctatcatgatgatggaattacgtactattatgag

SEQ ID NO: 26135 - DNA, 48 bp, Piromyces finnis
  PHOSPHOPANTETHEINE
gtatggtatcgattctctctctaccgttaaattaacaaatattttatc

SEQ ID NO: 26136 - DNA, 252 bp, Piromyces finnis
  PI-PLC-X
gggaagaactcaatctttagatatatatcaacaattaatgcatggaattagatatttagatataagacttgaaactaatccaaaaaaacaaatatatcttactcacgataaatttgattgtattaataaaaaaactaatgatttgtactatttaagtaatgtatttgatgaagctattaattttttacattataatccaagtgaaactgttattatgcatttaaaatgtgataattgtcatttccataagta

SEQ ID NO: 26137 - DNA, 255 bp, Piromyces finnis
  PI-PLC-X
atggggaagaactcaatctttagatatatatcaacaattaatgcatggaattagatatttagatataagacttgaaactaatccaaaaaaacaaatatatcttactcacgataaatttgattgtattaataaaaaaactaatgatttgtactatttaagtaatgtatttgatgaagctattaattttttacattataatccaagtgaaactgttattatgcatttaaaatgtgataattgtcatttccataagta

SEQ ID NO: 26138 - DNA, 237 bp, Neocallimastix californiae
  PIPLC_X_DOMAIN
atcacaatatcgtaaaacatccgctcaacatttcattcttcacaaaactgatggtaattatgatacctactatattactgctgaatgttctggtaacgctgctttagatgtttatgatcaaagctctgataatggagcaaaaattgatcagtggaattattggggtggagataatcaaagattttatattattccaatagatcaagagccaattgtctataacaacaataatatgcc

SEQ ID NO: 26139 - DNA, 321 bp, Piromyces finnis
  PIPLC_X_DOMAIN
caatcaaattaatattcctggtactcatgatagtggaacatatgctgtagattggcattcttttcctattataaatggctttagaagacaatggggaagaactcaatctttagatatatatcaacaattaatgcatggaattagatatttagatataagacttgaaactaatccaaaaaaacaaatatatcttactcacgataaatttgattgtattaataaaaaaactaatgatttgtactatttaagtaatgtatttgatgaagctattaattttttacattataatccaagtgaaactgttattatgcatttaaaatg

SEQ ID NO: 26140 - DNA, 321 bp, Piromyces finnis; identical to SEQ ID NO: 26139
  PIPLC_X_DOMAIN

SEQ ID NO: 26141 - DNA, 936 bp, Neocallimastix californiae
  PKS_AT
cttcacaggtcaaggcagtattaagccaggagttggtaaggaattatttagaacccaacccgtcttccgtgccgctatggaaaagtgtgatgctgtggttaagaagtctaccggaatttctattcttgatgccctctatgatcaaaatcaaggtcatcacttaaagaaggctcaaattgctcaacctgctttattcgcttatgaatatgctatgtacatgctttggaaatcttggggtattaagccagtcattgttaatggtcacagtttaggtgaaattgttgccgctgccgccaccggcgctatagatattgatttagccattgatttcattattgaaagagccagatgcatgggtgaatatggtgaaaagccaggagctatggttagtgttttccaaagtgaagatgtcgtcaaggaagcaattgaagaatttggttatgaagaagaagtttcaattgccgctatcaatggtgtaactcatactgttatttccggttatgaagatgaagttgatgatcttaccgagtatttcaatgaaatgaaggttaagactaaaaagttaaacgttaccgatgccttccattctccattaatggacccagccattgaagaattaaatggttggattgaagaaaagaatgatgcccagttcagacaaactttaaaggtaaagttcatttccaacgttgatagtaccattaagcctgtcggtgatcgtcttgaaaaggattactggggtaagcatgctagaaatgccgttcgtttcgttgacggtgtaaagtctatgattgaatccgaaaagaagttattggctgtcattgaagttggtccagccgccacgttgaccaacatgagttctcgtttcgttcgtgaaacagaatctcttcgtggtaagggtccaaccttcattgctagtagtgttgccgatcaaaa

SEQ ID NO: 26142 - DNA, 960 bp, Neocallimastix californiae
  PKS_AT
ttttactggtcaaggtgttgctaaggttggtatgggtaagcacttctaccaaactcaaccagttttccgtgaagctatggacagatgtgatgctgttactcgtcgtcttcttggcgtttccattgttgaggttttatataatgtttcaaacattccaaatggtactgaagaaggtgaaaaggctctcaagaagtcctctgttgcccaaccagctttattcgcttatgaatatgctatgagtcaattatggattagttggggaattaaaccatctatggttcttggtcattcacttggtgaaattgttgccactaccattgctggtggtattgactttgaattagctatggaattcattgttgaaagagcttcatgtatggaaaagtatggtattaagccaggtgctatggtttctatcttcactactgaagatgttgtcaaagaagctattgaagaatttgaatttgaaaatgtttccattgctgctattaatggtacaactcaaattgttatttctggtaatgcagatgaagtaaaagaattagaggaatactttattgaacaggatattaaggctaaacaattaaatgttactgaagctttccactctgctttaatggatccagctattgaaaagttatacgaatggattgatagtaagccagatgaaaaattccgtcaaccattaaaatatggtcttatttctaatgttactggtaagcttattccagctggtgaacgtcttccaaagaactactggggtgagcatgctagaaatgctgttcaatttgttaaggctgttgaaaccttattagccaatagtgaaactttattaaatgttattgaagttggtccagcttccgttttaactaacatgagttctcgtattttacgtgaaaagaaggttgataagtttgctgctccattctttgttgcttctgctcttccacgtgaaccaca

SEQ ID NO: 26143 - DNA, 903 bp, Neocallimastix californiae
  PKS_AT
tttttcaggacagggtactcaatatcctgatatgggtcgacaactgtatcattctaacccttattttgctaatattattgactattgtaacgaaatcgttctttccatctccaaaaaagatttattaaaggaaaccggtttattcggtgatttgccagtaaatgaagaaaacttaatggatcctcaatattccttcttagcgatcggtattattcaattggctcttgtagaattttggaaggcctatggtgtagaaccttcattggtctttggtcatagtatgggtgaagtagctgctgcatatgctgcgggtattttaactttagaagatgccattctcctactgtatcattatggtcttatcagtcaaaatttggaggaaaataatgagaagagtggattaattgctttaggttgtggcgtagatgaagctaaaactgaatatataaaggataggaagaaggtctatattgcttccattaatagttacaaggatgttacgcttggtggtgatctcaaccaattggaagagatcatggatcaagcaaaacaaaaaaatgtcttcaccgttatgctaaaggtcaataaggctttccataccccattcattctttcagctaaggagaaattccttaaaggtattgaaggtattcatttaagagttcagccaccaaagattccattcatctcttctactcatggtaatgaatatcaaggtccatttgatgccaactattggtggtccaatattattaatccagtgaactttagtcaagcagtaaaaattgctcataccaaggttgataaggtcttagaaattagtagtacgccagttttaggtatctatataagtagtgtcttccaacccgatagtatcttctataccctctcacgaaagctaaa

SEQ ID NO: 26144 - DNA, 903 bp, Neocallimastix californiae
  PKS_AT
tttttctggtcaaggttctcaatttataaatatgggtagacgtatgtatcaagtaaatggtcttttcaagagaattgtagactattgtgctgccgttcttgttacctacaatggtggtgaagatatttttgaaaagtaccatattttcaagggtgatgtttctcaaattagtgaagctgatctttctcttccacaatactctattcttgctattggtgttgctcaaattgctcttactgaaatttggaaggctatgggtgttactccagaagctgtttttggtcacagcatgggtgaagttgctgctgcctatgctgctggtattcttacacttgaagatgctatcttattattatacatgcgtggacatattcttgctcaattagatggtaccggaaaaggtatgctagctcttggatgttccgttgagcaagctcaatacttcatgaataataagccaaatgttttcatttctgctgttaatagtgctaactctatcactttagccggtgatattagccaaattaatgctatcgctcaagaagctaaggctcaaaacctcttcgctgttgttttaaaggttaagcaagctttccattctccatatgttgaaggtgctgaacaagcctttaaggaaagcattagaggtattagtgaacgtacttccgctccaaagtgtaaatttatttctgcatgctttggtcaagaatatgaaggtccatttgatgaaaactactggtgggctaacattcgaaatccagtaagtttctatgctgctgctagtattggtactcaattctctaaacgtgtattggaaattggtgctcacccagttcttagtgtgtatcttaaagaaatttatggtaaagaatatgtttatcaatcattatccagaaagatgga

SEQ ID NO: 26145 - DNA, 1392 bp, Neocallimastix californiae
  PKS_AT
tttcactggtcaaggtgctcaagaagttggtatgggtcaagatctctacaacaaatctgctgttgccaaggctgtttgggatagagctgatgcctacttaatgaagaagtacggttactctatcttggaaattgttcgtactaatccaaagtcccttaccgtttactttggcggtgaagatggtgaaaagattcgtgaaaactatatcaatatgacttgtgaaattattgattctaatggaaaggttcaaaccaaacgtatgttcccagaaattgatgaaaacaccctctactatgaatacaaatccccaactggtttgttaaatgctactcaattcactcaaccagcaattacccttactgaaaaggctgcctttgaagatatgtatgaaaagggttacatttgtgatgatgcagtttacgccggtcactctcttggtgaatacgctgctctttcctgtgttgctaacaccttaagtattgaaagtatggctgaaattgtcttctaccgtggtcttgtcatgcaatcctctgtcgaaagagatgaattaaaccgttctgactacgctatgtgtgccgttaatccagttcgtgtccatccatacttctcattcgatttattagttgaagttgtaaagaagattaacgccgaacatggtggtctcttggaaattgtaaactacaatgttgaaaactatcaatacgttgttaccggtgacttaacctctcttgaagctcttaagaacttattaactaatcttcgtgctgaagctaagaagttcatcaccttatacaaggaagatgctactcaagctatggaacttttaaacgaaaaggttcgtacctacgttaaattagctgaagaacgtaaggctaaggaaggtttcttcaatattgaaagaggtgctgctactattccacttcgtggtattgatgttccattccactccagttacttactttggggtgttccaaccttccgtgaattacttcaccaacgtgtccgtcgtgaagatgttgatgttaaatgtcttgttggtcgttacattccaaacttgatgggtgaaccattctctgttgaaaaggattatgctattcgtcttcaaaagcgtactaactctgcctacttggaaaagattattgaagaatgggatcaacacttgtttgaaattccatacattattatggttgaattattatcttatcaattagcttctgctgttcaatggattaagactcaagaattcttattcagttctcaaaagaagggtggtgctgatattgaacgtcttattgaatttggtccaactccaactttagttggtatggctaaacgtactcttggtatgaaatatgttaaatctgatcttgctcttggtaaaaaacgtcaact

SEQ ID NO: 26146 - DNA, 909 bp, Neocallimastix californiae
  PKS_AT
atttagaggaatgagccaattaaattcaaatattggctatagtttataccaatataaccaaaaatttgccgaaattgttgattactgtgataaggtacttgaaaaggtaagtggtggcgtttgctcacttaagagagaatttggtttattccaatcagaaaatttgaatttcctttctcttcaaaatccaaagatgtcaattattggtaatggcatgatacaattggctttgggtcatctattaaagagctatggtattaaaccatcttctgttgttggttacaattctggtgaaatcgctgctgcttatacagcaggtattattagtttagaggatgctatcttagttttatatcaatacagtactattttagaaaaagttccaaacaaaaagaatattttcactcttgaacttggatgttcagctggtcaagctcaaactaatattataaatcaattatccagtactatctatatttcaggtaataatgctgataatatttgtacactctgtggtagcagagaaagtcttaatcaagctgtttcaatcgcacagcaaaatggtattccagttttatctaatttaattccaggttcttgtggtatttgtacaccatatctaaatgattttaaggatgaattctttgcttcattaaagggtattggtaataattgcaagaccccagttattaaatttatttctacgactttgggacaaccatttaatggaccattaaatgaatattattggtgggcaaatttatcaagtactgtaaactttagtcatgctctttctcttgcaatgaatgaacaacaaaagggtagtgggtacattttagatgttggtagtggttacgctaatgctgctctctttaccaattactttggtgctttcactacagcagataa

SEQ ID NO: 26147 - DNA, 1404 bp, Neocallimastix californiae
  PKS_AT
cttcactggtcaaggtgctcaagaagtaggtatgggtatggacttgtatgaaaagtcaccagtagctagagaaatttgggatcgtgctgatgctcacttgatggaaaattatggtttctctattattgatattgttaagaataatccaactgaaattactatctactttggtaatgttaagggtcaacaaattcgtaagaattatcaacagatgacttatgaacatgttaattctgatggtgttgttgaaagtctttcactcttcccagaaattgatgacgacagtgtttcctacaccttccgtcacattggaggtttattatcggctactcaattcacacaaccatcccttgttttaatggaaaaggctgcttttgaagaaatgagatctcgtggtttcattcaacaaaacagtgcttttgctggtcatagtttaggtgaatatgctgccttaactgctattggtgatgtcttaagtattgaaacgttggttgatgtcgttttctatcgtggtatgactatgcaaagagccgttcaacgtgattctaagggtcgttccgattatgctatgtgcgccgttaatccaactcgtgttagccgtactttcaacgaaagtgccttacaatatcttgttgctaacattaagaaggttactgaaggtttaattgaaattgtaaactacaatgttgataactggcaatatgttgtttctggtgatcttatttccttacaagttcttactcttgtcttaaactacttaaaggctgaaaagattgatttaactgttttattgaacactctttctgttgaagaagttcaaaagcaagttaatgaaattattagtacttcctttgaaaaggctaaggaacaaaagaaaaagcatggctatattaaattagaacgtggtgctgcttctattccattacgtggtattgatgttccattccactctagtttcttattaagaggtgttgctccattccgtcaatacttgatgagtaagtttgatccaaacttgattgacgttaaccgtttaatcggtaattatattccaaacttaactgctgaaccattctctcttaagaaggaattcattgaaaatatttatgctaaaactaattcttctcgtattaagaatgtcttaaagggttggactgatgataaatacgcttctccacgtcttcaacaaaaattgggttacattcttttaattgaattattagcttaccaatttgctagtgctgtcagatggattgaaactcaagatagattattcgttgatattggtgttgaacgtttaattgaaattggtccaggtccaacactttctggtatggctcaaaagaccttaaagtttaagtatgaatactatgatgatgctaccagttatcgtcgtgaaattct

SEQ ID NO: 26148 - DNA, 1404 bp, Neocallimastix californiae; identical to SEQ ID NO: 26147
  PKS_AT

SEQ ID NO: 26149 - DNA, 861 bp, Neocallimastix californiae
  PKS_AT
tagagatttctattgtaataatagctactttgctgactgcattgattattgtgatcaggtattaaagatgataagtggacgttctcttcttgaagattatggtcttttccaatccgtaaaggaagaagaaaaggaaaaggaaaaggaaaagaaaaacaaattaagagaagatcttctcaaggatcctactactactcttttaattaatggtataattcaattaggattagtggcactctaccgttattatggcatttctccaaatgcagttattggttatggtgctggtgaaattgctgctgcctatgctgcagaaaagatagatttaaaatcggctgttcaaattctttatcattatggaagggtattatcgatggtgaagaaggatgataatctatccaaggtgtatagtatcttggtaggttgtcctgttggtaaattgagtcaggtgatactttccaagttaagtccaacggagaaggaattaatttcgatttccggagttccttctccaacgcaatgtgtattgaatggagaaatggaaatactaaagaagattatggagcaagcaaagactgaaaagattccaatacttggtagcctaatggattctttcgccatccacaccaaaaagatttctgaagcaatgaaggaagaactggtaaagcgtttaacgaacattaaatccaagccttcctccattgccatgttctcgaccaccaaattcagtaaagaaggaaagccatataccgacgcattagatggtcagtactggtggatgaatatgagaaatccagtgctctatgctcattccctctcccaaacggccaacttccttccaaccgatggtaaaaatatttt

SEQ ID NO: 26150 - DNA, 1404 bp, Neocallimastix californiae
  PKS_AT
tttcactggtcaaggtgctcaagaagttggtatgggtatggatttgtatgaaaagtctccagttgcaagagaaatttgggatcgtgcggatgctcacttaatggaaagctatggtttctccatcattgatattgtcaagaataacccaaccgagattactatttactttggtaatgttaagggtcaacaaattcgtaagaactatcaacaaatgacttatgagcatgttaatgctgatggtgttattgaaagtctttcactcttcccagaaattgatgatgacagtgattcttatactttccatcacattggaggtttattatcggcaactcaattcactcaaccatcgcttgttttgatggaaaaggcagctttcgaagaaatgagaactcgtggtttcatccaacaaaatagtgctttcgctggtcacagtttaggtgaatatgccgccttaactgctattggtgatgtcttaagtattgaaaccttagtggatgtcgtcttctatcgtggtatgaccatgcagagagctgttcaacgtgattccaagggtcgttctgattatgctatgtgtgccgtcaacccaacgcgtgttagccgtactttcaatgaaagtgctttacaataccttgttgccaacattaagaaggttactgaaggtttaattgaaattgtcaactacaatgttgataactggcaatatgttgtttctggtgatcttatttccttacaagttcttacgcttgtcttaaactacttaaaggctgaaaagattgatttaactgttttattaaatacactttcagtggaagaagttcaaaaacaagtaattgaaatgatcactaccgcctttgaaaaggctaaggatcaaaagaagagacatggattcattaaattagaacgtggtgctgcttctattccattacgtggtattgatgttccattccactctagcttcttattaagaggtgttgctccattccgtcaatacttaatgagtaaatttgatccaaacttgattgatgttaatcgtttaatcggtaattatattccaaacttaactgctgaacccttctctcttaagaaggaatttattgaaaatatttatgctaaaactaattcttctcgtattaagaatgtattaaagggatggacggatgataagtatgcttctccacgtcttcaacaaaagttaggttacattcttttaattgaattattagcttaccaatttgctagtgctgttcgttggattgaaactcaagatagattattcgttgatattggtgttgaacgtttaattgaaattggtccaggtccaacgctttctggtatggctcaaaagacattaaagtttaagtatgaatattatgatgacgctaccagctctcgtcgtgaaattct

SEQ ID NO: 26151 - DNA, 1392 bp, Neocallimastix californiae
  PKS_AT
tttcactggtcaaggtgctcaagaagttggtatgggtcaagaactctacaacaaatctgctgttgccaaggctgtttgggatagagctgatgcctacttaatgaagaagtatggttactctatcttagaaattgttcgtactaatccaaagtctcttaccgtctactttggtggtgaagaaggtgaaaagattcgtgaaaattacatcaacatgacctgtgaaattattgattccaacggaaaggttcaaaccaagcgtatgttcccagaaatcgatgaaaacactctctactacgaatacaagtccccaactggtttattaaatgctactcaattcactcaaccagctattactcttactgaaaaggctgcctttgaagatatgctcgaaaatggttacatctgtgatgatgctgtctatgctggtcactctcttggtgaatatgccgctctttcttgtgtcgctaacaccttgagtattgaaagtatggctgaaattgtcttctaccgtggtcttgttatgcaatcctctgtcgaaagagatgaattaaaccgttctgactacgctatgtgtgccgttaatccagttcgtgtccatccatacttctcttacgatttattagttgaagttgttaagaagattaacagtgaacacggaggactcttggaaattgttaattacaacgttgaaaactatcaatacgttgttaccggtgatttaacttctcttgaagctcttaagaacttattaactaaccttcgtgctgaatcaaagaagttcattgccttatacaaggaagatgctactcaagctatggatctcttaaacgaaaaggtttgtatctacgttaaattagctgaagaacgtaaggctaaggaaggtttcttcaatattgaaagaggtgctgctactattccacttcgtggtattgatgttccattccactccagttacttactttggggtgttccaaccttccgtgaattacttcatcaacgtgtccgtcgcgaagatgttgatgttaaatgtcttgttggtcgttacattccaaacttaatgggtgaaccattctctgttgaaaaggattacgctattcgtcttcaaaagcgtactaactctacctacttggaaaagattattgaagaatgggatgatcatttattcgaaattccatacattattatggttgaattattagcttatcaattagcttctgctgttcaatggattaagactcaagaattcttattcagttctaagaataagggtggtgctgatgttgaacgtcttattgaattcggtccaactccaactttagttggtatggctaaacgtactcttggtatgaactttgctaaatctgatcttgctctcggtaagaaacgtcaact

SEQ ID NO: 26152 - DNA, 784 bp, Neocallimastix californiae
  PKS_AT
cttcactggtcaaggtagtatcaagccaggcgttggtcaagaattattcagaagtcaaccagttttccatgcagctatggaaaagtgcgatgctgttgttaagaaggttaccggtgtttctatcattgatgccctctatgatcaaagtcaagcccatcacttaaagaaggctcaaattgctcaacctgccttattcgcttatgaatatgccatgtgtatgctttggaagtcttggggtgttgaacccgtcatcgtcaatggtcacagcttaggtgaaattgtggctgctgctgttactggtgctatcgatattgatttagccatcgatttcattattgagagagccagatgtatgggtgaatatggtgaaaagcctggagctatggtcagtattttccaaaatgaaaaaactgtcaaggaagccattgaagaatttggttacgaagaagaagttgcgattgcggccatcaatggtgtcactcataccgttatctctggttatgaggaggaggtcgatgatattacccaatactttagtgaaatgaacattaagacgaagaagttaaacgttaccgatgctttccattctccattaatggacccagctatcgaagaattaaataactggattgaagaaaaggatgatgctaagttcagacagtccttaaaggttaagttcatctctaatcttgatggtaccattaagccagttggtgatcgtcttgaagaagattactgggctaaacacgctagaaatgctgttcgtttcgttgatggtgttaag

SEQ ID NO: 26153 - DNA, 735 bp, Neocallimastix californiae
  PKS_AT
tttctgtccgggaaatagaaatgtacaaaaagaagacaagttaaaggaagatcttcttaaggatccttcaaccgctcttttaattagtggtattgttcaatttagcttggtatctctctataaatactatggtattacgcctagtgttgttattggctatggtgcaggtgaaattactgcggcgtatgcagctgaaaaaatagatttgaaggatgccgttcagattctttaccactacggtcaagtcctatccatggcaaacaattcatcaccaaaagtttactcttttctggttggttgtcctgtgggaagattgaatcatatgatggtttccaagttgactccatccgaaaaggatcttatttctatttctggtattccaaatccaagacaatgcattctttgtggtgagatggaaattttgaaaaaagttatgaagatgatcaaggatgaaaaggtaccaattctcagtggctttatggaaagctttggtatacattctaagataattacagaagctatgaaggatgaattaacaaagcgtcttgaaaacatttcatctcattcttcttctattgcgatgttttcaactgcaaaattcaatgagaagagcgaaccgtacactggtgctttagatggttcatactggtggatgaatatgagaaatccagtactttatgcccatactctttctcaaacagttaactaccttccttctgatggtaagaatatttt

SEQ ID NO: 26154 - DNA, 1395 bp, Anaeromyces robustus
  PKS_AT
ctttactggtcaaggtgctcaagaagttggtatgggacaagaattatataataaatcggctgtcgctaaatccgtttgggatagagctgatgcctatttaatgaaaaagtatggttattccattttagaaattgttcgtactaatccaaaatctttaaccgtttactttggtggcgaagaaggcgaaaagattagagaaaactatatgaatatgacttgtgaaattattgattctaatggtaaggtacaaactaaacgtatgttcccagaaattgatgaaaatactctttactatgaatacaaatcacccaatggtttattaaatgctactcaatttactcaacctgctattacccttactgaaaaggctgcctttgaagatatgcttgaaaatggttacatttgtgatgatgccgtttatgctggtcactctcttggtgaatatgctgctcttagttgtgttgctaatactttaagtattgaaagtatggctgaaattgtattctaccgtggtcttgttatgcaatcctctgtagaaagagatgctcttaaccgttctgattatgctatgtgtgctgttaatccagtacgtgttcatccttacttctcttatgatttattagtagaagtcgttaagaagattaatagtgaacatgatggtggtcttcttgaaattgttaattataatgtagaaaattaccaatatgtcgttactggtgatattacttccttggaagctcttaagaatttattaactaaccttcgtgctgaagctaagaaattcattactttatataaggaagatgctagtcaagctatggatctcttaaatgaaaaggtcgttcattatgttaaggaagctgaagaacgtaaagctaaggaaggatggttcaatttagaaagaggagctgctactattccacttcgtggtattgatgttccattccattctagttatttattatggggagtcccaaccttccgtgaattacttcatcaaagagttcgtcgtgaagatgttgatgttaaatgtcttgtaggacgttatattccaaacttgatgggtgaacctttctctgttgaaaaggattatgctattcgtcttcaaaaacgtactaattctacctatttagaaaagattattgaagaatgggatcaacatcttttcgaaattccatatattattatgattgaattattagcttatcaattagcttctgctgttcaatggattaaaactcaagaattcctctttagtagtgaaaagaagggtggcgttgatattgaacgtcttattgaatttggtccaactccaactttagtgggtatggctaaacgtactcttgctaagaattatagtcaatctgatcttgctcttggtaagaaacgtcaact

SEQ ID NO: 26155 - DNA, 909 bp, Anaeromyces robustus
  PKS_AT
tttttcaggtcaggccactcaatacccagatatgggtcgtcaactttatcattctaatccttattttgctagtattattaattattgtaatgaaattattattcgtttgtcacaaaaagatcttattaaagatactggattgtttagtgatacaccagtagatgaagaaaaattaattgatccacaatattctttccttgctataggtattattcaattagcccttgttgaattttggaaattatatggtgttgaaccagctcttgtttttggtcatagtatgggtgaagttgctgctgcttatgctgctggaattttaaccatagaagatgctatcttattactttataattatggtcttattagtcaaaatgttgatgatattcatgaaaagagtggtatgttagctcttggttgtagtgctgaagaagctaaaactacttatttaaatggtaaagataaaaatagagtttatattgcttctattaatagtgaaaaagatataacacttggaggtgatcttaatcagttagatgctatcatgactcaagctaaaaataataatgttttcacggtaatgttaaaagttaaaaaggcattccatacaccatatattattacagcaaaacaaaaatttattcaaggcattcaaggtattggtagtagagttaattcaccaaaaattccatttatttcttcaacttatggtaaagaatatcaaggaccatttgatgaagaatattggtggactaatattattaatccagttaactttagtcaagctacaaaagtagctcgtactaaagtagaaaaagtattagaaattggttcaacaccggtattaggtatatatatgagtaaaattttcaatccagataatattttctattctttatcacgtaaattgaa

SEQ ID NO: 26156 - DNA, 957 bp, Anaeromyces robustus
  PKS_AT
attcactggtcaaggtgttgctaaggttggtatgggtaaacatttctaccaaacacaaccagtcttccgtaaggctatggacaaatgtgatgaagtcactcgtcgtcttcttaatgtatctattgttgaagttttatacaatatttctaatgcaccaaatggtattgaaaaaggtgaaaatgctcttaaaaaatcttctgttgctcaaccagccttatttgcttatgaatatgctatgagtcaactttggataagttggggtgttgaaccatctatggttcttggtcactctcttggtgaaattgttgctactactattgcaggtggtattgatttcgaattagctatggaattcattgttcaaagagcttcttgtatggaaaaatatggtattaaaccaggagctatggtttcaattttcactactgaaagtgctgtcaaagaagctattgaagaatttgaatttgaaaatgtttctattgctgctattaatggtactactcaaactgttatctctggtaatgctgatgaagttaaagaattagaagaatatttcattgaacaagaaattaaggctaaaccattaaatgttactgaagctttccattctgctttaatgaatccagctattgaaaagttatacgaatggattgaaactaaaccagatgataaattccgtaaaccattgaagtacggtcttatttctaatgttactggtgaacttattccagctggtgaacgtcttccaaagaactattggggtgaacatgcaagaaatgctgttcaatttgttaaggctgttgaaaccttattagctaacagtgagactttattaaatgttattgaagttggtccatctaatgtcttaactaatatgagtgctcgtattttacgtgaaaagaagattgataaatacaccaatccattctttgtcgcttctgcttctccacgtgttga

SEQ ID NO: 26157 - DNA, 939 bp, Anaeromyces robustus
  PKS_AT
tttcactggtcaaggtagtattaaaccaggtgttggtcaagaattatatagaagtcaaccagttttccgtgatgctattgataaatgtgatactgttttaaagaaggtcactggtatttcacttgttgatgttctttacaatccacaacaagctcatcatttaaagaaagctcaaattgcacaaccagctttatttgcttttgaatatgctatgtgtatgctttggaaatcttggggtgttgaaccaactattgttaatggtcatagtttaggtgaaattgttgctgctgctgttactggcgcaatggatattgatttagctattgatttcattgttgaaagagctagatgtataggcgaatatggtgaaaaaccaggtactatggttagtatttttgaaaaggaagatgttgttaagaaggctattgaagaatttgatactcaagaagaagttgctgttgctgccattaatggtgtagcccacaccgttatatctggttatgaagatgaagttgatgatattactgaatatttcaaacaaatgaatgtcaagactaagaaattaaatgttactgatgctttccactctccattaatggaaccagctattgaagaattagataaatggattgaaggaaaggatgatgaaaaattcagacaaccattaaaggttagatttatttctaatgttgatggtaagattaaggaagttggtgaacgtcttgatgaaaattattgggctgaacatgctagaagtactgttagatttgttgatggtgttaaatctatgattgaatctgaaaataataatatattagctgtgattgaagttggtccagctgctactttatctcatatgagtgcacgttatgttcgtgaaaatgaagctcttcgtggtaaaggtccacatttcattccaagtggatcagctgatcaaaa

SEQ ID NO: 26158 - DNA, 1404 bp, Anaeromyces robustus
  PKS_AT
ctttactggtcaaggtgctcaagaagttggtatgggtatggacttgtatgaaaaatctgctgttgctagagaaatttgggatcgtgctgatgctcacttaatggaaacttatggtttctctattattgatattgttaaaaataatccaactgaaattactatttactttggtaatgttaagggtcaacaaattcgtaagaattatcaacaaatgacttatgaacatgttaatgctgatggtgttattgaaagtctttctcttttcccagaaattgatgatgatagtacttcctacactttccatcatattggaggtttattatctgctactcaatttacacaaccttccttagtattaatggaaaaggctgcttttgaagaaatgagatctcgtggtttcattcaacaaaatagtgctttcgctggtcacagtttaggtgaatatgctgccttaactgctattggtgatgttttaagtattgaaactttagttgatgtcgttttctatcgtggtatgactatgcaaagagctgtccaacgtgattctaagggacgttccgattatgctatgtgtgctgttaacccaactcgtgttagtagtactttcaatgaaaatgctttacaatatcttgttgctaatattcaaaaggttactgaaggattaattgaaattgtaaattacaatgttgataactggcaatacgttgtttctggtgatcttatttctcttcaagttcttactaatgttttgaactacttaaaggctgaaaagattgatttaactgttttattaaatactctttccgtagaagaagtacaaaaacaagttattgaaattgttactaatgcttttgaaaaggctaaagaacaaaagagaaagcgtggatttattaacttagaacgtggtgctgcttctattccacttcgtggtatcgatgtaccattccactctagtttcttattaagaggtgttgctccattccgtcaatatttaatgagtaaatttgatccaaatcttattgatgttaatcgtttaattggtaattacattccaaacttaaccgctgaaccattctcattagaaaagaagtttattgaaaatatttatgctaaaactaattctagtcgtattaagaatgtattaaagggttggactgatgataaatatgcttcaccacgtcttcaacaaaaacttggttatattcttttaattgaattattagcttatcaatttgctagtgctgttcgttggattgaaactcaagatcgtttattcgttgatattggtgttgaacgtttaattgaaattggtccaggtccaacactttctggtatggctcaaaagactttaaaattcaagtatgaatattatgatgatgctactagttatcgtcgtgaaattct

SEQ ID NO: 26159 - DNA, 834 bp, Anaeromyces robustus
  PKS_AT
atacaagtataatcaaaagtttgctaaaattgttgactattgtgataaggttcttgagaaagttagtcaaggtttatcccttaagagagattatggtcttttccagaaggaaaactttgatgaaaccactttaagagatccaaaaatttctgttattggtagtggtattattcaacttaccatggctcatctcttaaaatcctatgctattattccatcctctgttgttggttatagtattggtgaaatttccgctgcttatgccgctggtattatttccttagaggatgcggttcttattttatatcaatatagttctattttagaaaaggttccaggtaaggaagatatttacactgttgaattaggatgttcttctgatcaagctcaagttaatattcttagtcaattatctgctccagtttatattgttagtaatagtactagtaatatatgtacactctgtggtaatagtaccttcttaaatcaagctattcaaatggctcaacaattaaatatcccaattttatccaatttaacaccaggatcaaatggaatttgtactccatatcttaatgactttaaggatgaattctatgaatctttaagagatattggtagtagatgtaaggatccagttattccatttatttcaactactttaggtcaaccatttaatggtccattaaatgaattctattggtgggctaatttaactagtactgttaactttagttctgctctttcacttgctatgaatgagcaaccaaatggtagtggttatattttggatgttggtagtggttattctagtacacttttccataattatct

SEQ ID NO: 26160 - DNA, 936 bp, Piromyces finnis
  PKS_AT
tttcaccggtcaaggtagtattaaatcaggtgttggtttagaattatacagaactcaaccagttttccgtgatgctcttaacaagtgtgatgttgttgttaaaaaggctaccggtatttctcttattgacgctctttacaatccaagtcaaagtcatcacttaaacaaggcacaaattgctcagccagctttatttgcttacgaatatgctatgtgtatgctttggaaatcatggggtattaacccaactattgtcaatggtcacagtttaggggaaattgttgctgctgcttctactggtgctatggatattgatttagctattgatttcattattgaaagagctagatgcatgggtgaatatggtgaaaaaccaggtactatggttagtgtatttgaaaaggaagatgtcattaaggaagcaattgaagaatttggatatgatgaagaagtttctgttgctgctattaatggtgttactcacactgttatctctggttatgaagatgaagttgacgatatcaccgaatactttagtcaaatgaacattaagaccaaaaaattaaatgttactgatgctttccattcaccattaatggatccagctgttagcgaattaaataaatggattgaaagaaaggatgactccaaattcagacaagacttgaaggttaaatttatttctaatgtcgatggtaacattaaaccagttggctctcgtcttgaagaagactattggggtaagcatgctagaaatgctgttcgtttcgttgatggtgttaaatccatgattgaatccgaaaagaagttattagctgttattgaagttggtccagccgctaccttaactaacatgagctctcgtttcgttcgtgaaaccgaatcacttcgtggtactggtccaaccttcattgctagtagtgttgctgatcaaaa

SEQ ID NO: 26161 - DNA, 846 bp, Piromyces finnis
  PKS_AT
aggttatagcttataccaaaataataaaatgtttgctgatgttgttgactattgtgacaagattcttgagaagattagccagggctactctgttaagaaaaacaccggtcttttcttaaaggaaaacttagatgctgctacccttcaaagtccaaagatttctgttgttggtagtggtatgatccaacttgctatggctcatcttttaaagacctatggtattgttccatcctctgttgttggttacaatactggtgaaatcgctgctgcttatgccactggtattatttctttagaagatgccattcttattttataccaatttagtaatatattagaaaaggtcccaggtaaggaagatatctatacccttgaacttggttgttctgctgaacaagctcaatctagcataattaatcaactctctacttccgcttatattactggtaataatgctagcaatatttgtacactttgtggtagtagtgctgccttaaaccaagctattcaattagctcaacaatccaatattccaattttatctaatttaattccaggatcatgtggtatttgtactccattccttaacaatttcaagaatgaattccatgaagccttaaaggacattggtagccgctgcaaagctccagcaactccatttatctcaactactttaagtcaaccattcaatggtccattaaatgaatattattggtgggctaactttactagtactgttaactttaatgttgctctttcccttgctatgaatgaacaacaaaaaggtagtggatatattttagatgttggctgtggttattccaatgctcttttcaacaattatct

SEQ ID NO: 26162 - DNA, 957 bp, Piromyces finnis
  PKS_AT
tttcactggtcaaggtgttgctaaggttggtatgggtaagcatttctatcaaactcaaccagttttccgtaaggctatggacaaatgcgatgaagttactcgtcgtcttctcgatgtttctattgtcgaagttctttacaatatctcaaattctccaaatggtgtcgaagaaggtgaaaaggctcttaagaaatcttcagttgctcaaccagctttatttgcttatgaatatgctatgagtcaactttggattagttggggtgttgaaccatcaatggttcttggtcattcacttggtgaaatcgttgctacaactattgcaggtggtattgactttgaattagctatggaatttattgttcaaagagcttcttgcatggaaaagtatggtgtaaaaccaggtacaatggtttctgtatttactactcaagatgttgttgaagaagcaattgaagaatttggttttgaaaatgtatctattgctgctatcaatggtaccactcaaattgttatttctggtaatactgatgaagttaaggaattagaagaatacttcacacaacaagaaattaaggctaaacaattaaatgttactgaagccttccattctgctcttatggatccagctattgaaaaattatatgaatggattaatactaaaccagatgaaaagttccgtcaaccattaaagtatggtcttatttctaatgttactggtgaacttattgaggctggtgaacgtcttccaaagaattattggggagaacatgctagaaatgctgttcaatttgttaaggctgttgaaaccctattagctaatagtgaaactttattaaatgttattgaagttggtccagctaatgttttaactaatatgagttctcgtattttacgtgaaaagagaattgacaaatttgctactccattcttcgttgcttctgctgctcctcgtgtaga

SEQ ID NO: 26163 - DNA, 957 bp, Piromyces finnis; identical to SEQ ID NO: 26162
  PKS_AT

SEQ ID NO: 26164 - DNA, 864 bp, Piromyces finnis
  PKS_AT
ttgtagaaatctttactgtaataataaatacttttctgattgtattgattattgtgatggtattttcaaggctttaagtcaacgttctcttcttcaagattacggcttatttactactgaaatgatggataacaataaatttaaaaaatttaattctgatcttagaaaggatccattagtcatgataatgtttggtggtatggttcaattaactttgtctgccttattaaaatattatggtctatttcctaatgcagttattggttatggtgctggtgaaattgttgctgcctatgttgctgataagatggatttaaagactacggttaaagttctttaccactatggtagagttttaagtcacgcttactctcaagaaaataaggtttatactcttactttaatctgtccaattagtaaaattaaacaaaccattttcaccaaactaaatcaagatgaaaaagatggcatatcaatttcgggtattccaagtccaaagttctgtttacttagtggtgactataatatcatgaaaaaggtttccgatattgccaagagtgaaaatattgccatttatggtgctatgcaaaataattatggcttacattcaatgatgattaatgataaaatgaaggaagatcttgtgaacagtcttaaggacattcctttacaaacttctgatattgctttcttcactaccactaagctcaataaggatggtaagccatacgaaggaaaactagacggtgaatactggtggatgaatatgagaaatccagttctttatgctcacgctttatctcaaacagtcgcctttttaccaatagatggtaagaatataatagaaattggttttggttttga

SEQ ID NO: 26165 - DNA, 1404 bp, Piromyces finnis
  PKS_AT
cttcactggtcaaggtgctcaagaagttggtatgggtatggacttatatgaaaaatccccagttgctagagaaatttgggatcgtgctgataagcatttaatggaaaactacggtttctctattattgatattgttaagaacaatccaactgaaatcactatttactttggaaatgtaaagggtcaacaaattcgtaaaaattatcaacaaatgacttatgaacatgttaataatgaaggtgttgttgaaagtctctcacttttcccagaaattgatgatgatagtgtttcttacactttccgtcatattggtggtttattatcagctactcaattcactcaaccatctcttgtattgatggaaaaggctgcctttgaagaaatgagatcccgtggttacattcaacaaaacagtgcttttgctggtcacagtttaggtgaatatgccgctttaacagctattggtgatgttttaagtattgaaactttagttgatgttgtcttctatcgtggtatgactatgcaaagagctgtccaacgtgattctaagggacgttctgactatgctatgtgcgctgtcaacccagttcgtgttggtagtacttttaatgaaagtgctcttcaatatcttgtcgctagtattaaaaaggttactaatggtttaattgaaattgtaaactataacgttgataactggcaatatgttgtttctggtgatcttatttccttacaagtacttactcttgtcttaaactacttaaagtttgaaaagattgatttaactgtattattaaagactctttctgaagaagaacttcaaaagcaagttaatgaaattattaacaatgcctatgtaaaggcaaaggatcaaaagaagaagcacggatttattaaattagaacgtggtgctgcttcaattccattacgtggtattgatgtaccattccactctagtttcttattaagaggtgttgctccattccgtcaatacttaatgagtaagtttgatccaaaattaattgatgttaaccgtttaattggtaattatattccaaacttaactgctgaaccattctctcttgaaaagaagtttattgaaaacatttatgcaaagactaactctactcgtattaagaatgttttaaagggatggactgatgataagtatgcttccccacttcttcaacaaaagttaggttacattcttttaattgaattattagcttaccaatttgcaagtgctgttcgttggattgaaactcaagatagattattcgttgatattggtgttgaacgtttaattgaaattggtccaggtccaactctttctggtatggctcaaaagacattaaagttcaagtatgaatattatgatgatgctactagttaccgtcgtgaaattct

SEQ ID NO: 26166 - DNA, 1404 bp, Piromyces finnis; identical to SEQ ID NO: 26165
  PKS_AT

SEQ ID NO: 26167 - DNA, 1404 bp, Piromyces finnis; identical to SEQ ID NO: 26165
  PKS_AT

SEQ ID NO: 26168 - DNA, 1404 bp, Piromyces finnis; identical to SEQ ID NO: 26165
  PKS_AT

SEQ ID NO: 26169 - DNA, 903 bp, Piromyces finnis
  PKS_AT
cttctcaggtcaaggtactcaatatccagaaatgggtcttcaactttacaatatgaacccatatttcgcaagtattattgattactgcaattctatccatacccaaatttctaaaaaagatcttttaaaggagactggcttatttggtaagggtcctgtaaatgaagaaaaacttttagatccacagtattcattcccagctattggaataatagaattagctctagttgaactatggaaacgttatggtgttgaaccagctcttgtctttggtcatagtatgggtgaagttgctgctgcttatgctgctggtattttaactattgaggatgctattcttttactttataactatggacaaataagcgaaaatgtagttgatgctggtgcaaagagtggtatgttagctattggttgtagctctgaagaagctcaatcaatttacttaaagggtaaagataaggtttttattgcttcaattaatagtccaaaagatattactcttggtggtgatcttgaacaacttaatgaaattatggctgaagccaggaagaacaatgtcttttctgttatgttaaaggtaaagaaggctttccatacttcctacattattacagctaaggacaaattccttcaaagtatccaaggtattggtaatagagttaaagcaccaaagattccattcatatcctctacctatggcagagaatatcaaggtccatttgatgaagaatattggtggacaaatatcattagtccagtcaactttagccaagcaaccaagattgctcgttcaaagatcgataaagttttagaaattggttccacaccagttttaggtatctatatgagtaacgatttccatcaggataatatcttctataccctttctcgtaagttaaa

SEQ ID NO: 26170 - DNA, 903 bp, Piromyces finnis
  PKS_AT
tttctctggtcaaggttctcaatttataaatatgggtagacgtatgtatcaaaccaatgatctctttaagaaggttgtcgattattgtgctgctgttcttgttactattaatggcggtgaagatatctttgaaaagtatagcatctttaagggagatgttgctcaaattagcgaaaccgatctttctcttccacaattctctgttcttgctattggtattgctcaaattgctttaattgaagtttggaagtctatgggtgttacaccaaaggctgtctatggtcatagtatgggtgaagttgctgctgcttatgctgctggtgttcttactatcgatgatgctgtcttattattatacatgcgtggtcatattcttgctcaattagatggtactggtaagggtatgttagctcttggatgctcagttgaaaatgctcaacgcttcatggctaataagccaaatgttttcatttctgctgttaacagtgctaattctattactttagccggggatcttgaacaaattaatgctgttgcaagagaagctcaagctgaaaaactttttgctgttgtattaaaggttaagcaagctttccattctccatacgttgaaggtgctgaaaaggctttcaaggaaagtattagaggcattggtgaacgtactaaagctccaaattgtaagtttgtttctgcttgttttggtcaagaatatgaaggtccattcgatgaaaattactggtgggctaatattcgtaatccagttagtttccatgctgctgcttctattgctactcaattctctaagcgtgttttagaaattggtgctcatccagttcttggtatgtatcttaaggaaatctatggtaaggataacgtctacttctccttatctcgtaagatgga

SEQ ID NO: 26171 - DNA, 690 bp, Piromyces finnis
  PKS_AT
ctatctctaccgtactcaacctgtctatgctaaagccttagaagaatgtgataagattatcactgagttaagtaactttaagattttattggtcaatttggttatttgtatgggcgaattgatacaaccagaattattacaagaatacaaaaagcaagtagatgaagatccatgtatggctcaattcattgctctttccatgaactatgctttaataaaacttttagaacatttatctatttcaccaaatcttgttgtgggttataaatttggtgaaattacagctgctcttgcctgtggtaagatttctttgagaaatgctttccttattattcattacatttgtaaaataattcgtaagaatatccaactttctgatgaaactattacttcagatatcactcaattaatgattataaaggatgaatcgaaggcattttcatctgcaaagaataatgattattcctacagaatggaacatagtcaatccttttattcttccattcatcaacaggtattttcaaagggtcaaaatctcaatggagattattgggttaaatttgtcaagtctatgatttctaaggaagaagaccacaatacctctatgataaaccaatacaaaaaagctattgaaaagtttaacagtgatctctgtctttttattcatacctcttttatggaaggtcttga

SEQ ID NO: 26172 - DNA, 981 bp, Neocallimastix californiae
  PKS_ER
tcttaacgctaaagaaaagttacaaccatacgaatacactccagaaccattagctgatgaccaaattgaagttaaggttactcataatggtttatgtcacagtgatattcacatgaaggataacgactggggaaattcttcttatccattcattccaggtcatgaagttattggtaatgttgttgccttaggtgctaatgctgaaaaactttctggtcttaaggttggtgacagagttggttatggttggattcgtgatagttgtggtttctgtgaatgttgtattgaaggtcaagaaaatctttgtgaaaagggttatgaaggtactattgttggtcatcatggtggtttccaagatcgtattagaatgccagctaaatttgcttttaagattccagaaaagcttccaagtgaatatgctgctcctttaatgtgtgctggtgctacagtttataatccacttcgtttattcattgaaaaaccaaatgttaaagttggtgttattggtattggtggtttaggtcatttagctgttcaatttgctagtaaaatgggttatgaagttactgctctttctacttcttataataaaaaagaagaagctactggttttggttgtcataactttgttttattaaaggaagctgctgaaaaagttccaaattatttcgatttaattattaatacttctccatatgatatggattggaaaatgcttttaggtttacttagaccaaatggtaaattatgtttaattggtattccagctgttgatatgaaagttccagttatgccaattattttctctcaaaagactatttgtggttctattgttgctggtagaaaattcactaatgaaatgcttgaatttgctgccttaaatggtgttaaaccaaaaattgaacttatgaagttatctcaatgtaatgaagctatcgaaaaggttttagctaacaaggctagatacagaattgttttaga

SEQ ID NO: 26173 - DNA, 1020 bp, Neocallimastix californiae
  PKS_ER
tgaacctggttgggttgaaaaagaaaaacccaaatgtgggccaatggatgctatttgtaaaccattagccattgcggtatgtacttcggatgttcatactgtatgggaaggagctattggagatcgtcatgatatgattttaggtcatgaatgttgtgctgaagtagttgaagttggttctgaagtcaaagatttcaaaccaggggatagagttattgttccagctattactcctgattggaattctttagaagctcaagctggttattcgatgcattcacatggcatgcttgctggttggaaattctctaacattaaggatggggtattctctgaatatttccatgtcaatgatgctgatggtaatcttgctcatttaccttcctctattaatactgtagatgcttgtatgctttcagatatggttccaacaggttttcatgctgttgaacttgctgatattcaatttggtgatgttgttcttcaaattggtattggtccagttggtcttatgtctgttgctggtgcttctcttagaggtgcttcacgtattatttgtgttggaactcgtaaagtttgtcaagatgttgctagaaaatatggtgctaccgattttatttcatacaagaatggaactattgaagaacaagttatgaaattaactgatggcaaaggtgtcgatcgtgtatgtattgctggaggtacggtaaaaactttcgaatctgctattaaatgtcttaaaccaggaggtaagattggtaatgttaattatcttggttccggcgaattcgttaccattcctcgtgtagaatggggtgttggtatgggtcataaggatatccgaggtggtcttatgccaggtggtagacttagaatggaaaagcttgcttccctagttgtggctggtcgtctcgatctctcaccattaagtactcacgtatataacggttgggaagaagttccaaaagcattacaaattatgaaagataaaccagctgaccttattaaacctgttatcaa

SEQ ID NO: 26174 - DNA, 1002 bp, Neocallimastix californiae
  PKS_ER
tatggttaaacttgatgacatgaaaattgttaagagcgtcgttccagaattaggtgaaaacgatgttttacttaagaacctttgctgttctgttgatccattcatgcgtggtcgtatgagaaagggtgttaaatcctacgttgcttccttcgaagaaggtaagccaatgccagtcttctctgttactcaagttgctaagattggttctgctgttactgacattaatgttggtgacaagtacatgtgcttcaacggtattgaaaagtacaccgttcttccacaacaagttattaagggtgaaggtgaaaagaatcttggtagtttcaacaagattgatccaaacaacccactcaaggactctttctaccttggtttattcggtatgccaggtatgactgcttgggctttcttcaacaaggccggtaagccaaaagaaggtgaaactatcttcgttactgctgccgctggtgctgttggtcaagttgtttgccaacttgctaagcttaagggtttaagagttgttgcttgtgcttcctctccagaaaagattggtttcttaaagcaagccattaaggtcgatgaagctttcagttaccgtgacttcccagacaaggaatccttcactgctcaattacgtaaggtttgtccaaacggtatcgatatctactacgataacgttggtggatacattcttgattctgctcttgaacttatgaacattcacggtagagttattatgtgtggtatgatctctcaatacaaccttaccgaaaagtacaagtacactcttagagatattacttccagaagacttactcttcaaggttgtttattcaacgattacttcccacaatgcatgggtgaattcatgcaagatatgattccaaagttacaacaaggtaagctcatctacaaggaacacatttacaagggtgttgaaaagaccccagaagctttccttggtttattcaacagtgaaaactttggtaaggttgttattga

SEQ ID NO: 26175 - DNA, 1005 bp, Neocallimastix californiae
  PKS_ER
acaaccaaaagatgttttaagtttaaaagaattaaaaattccaaaaattagggataatgaagttttagtgaaatttttagcagctccaattaatccttctgatattaatcaaattgaaggtgtttatccaattaaaccaagatttagagaatatggtgcagtgggtggtaatgaaggtgtcgctgaagtagttgctgctggttctaaagttaaaaacttaactataggtgattgggttattccagattccaaagctttcggaacttggcaaactttcgctgctagttcagaaaatgaattacaaaaaattagtaaaaacggtatttctaagataagcgctgcaactatttctgttaatcctccaacagcttatagaatgttaaaggactttgttaacttaaaaaaaggtgatgttgttattcaaaacggagctaatagtgcagttggtcaatctgttattcaaattgctaaagcttggggtattaaaactattaatgtcatacgtgacagaccaaattttgaagaagttgctggagaattacataaacttggtgctacattagttattaaagaagaggatttacgttctaattctactcgcgaacttgttaagaacttaggtagtccagttcgtttagctttaaattgtgtcggaggaaagtcagcttctggaattacacgtttacttggccaaaatgctactattgttacctatggaggtatgtctaagcaaccacttactttcggtactggtccatttatttttaagaatttacgtgcaagtggtttttggatttctcgttggaacaaagaagcttcaaagaaagataagcaatatatgtttgatgatatttgtgaacttgttcgaggtggtcatttagcagaaccatggcatgaagaaactaaatgggaaacaagtgatgataataagaccttaaataaaaagttcatgacagctcttggtaaagctggcgctagttttggaaacaaaaaacaaattttaac

SEQ ID NO: 26176 - DNA, 987 bp, Neocallimastix californiae
  PKS_ER
tcaattcagtaattttggagtatcacttgttgaaagaagagctttaagagatgatgatgttgaaattgatattaaatattgtggtatttgtcactcagatattatgattgtacaaattaatcaaccaggaaaaggtgttgttccaggtcatgaaattaccggtgttgtaaaatctgttggtaaggcagttacaaatttcaaagtaggtgatcatgttggtgtaggttgttttgttaactcctgtagtaactgtgaatactgtaaacgtggtgatgaacaattttgtgataagggtgtagttgttgtatttaatagtaaggattatgatggtgcaataacctatggtggttatactcaaactattatcgtcaaagataaatttgttttacatataccagattcacttgatttagctgtggctagtccacttctttgtgcaggtattactacttacagtccattaaaacgttataatattggtaaaggatctcgtgttgcaattatgggtttaggtggtttaggtcaccttggtgtacaatttgctcatgctatgggagctgaagttaccgttcttggtcattcagaatccaaaaaagaggaagccaagaaacttggagccgattgttatgaaattttaaagactgatgaagatttcaaaaaatattacagaacctttgattttattttaaattgtgctactgctaatcttaatttagataaccattttaaattattaaaaccaaatggtgtcctatgttttgttagtattgtaccagaggaacaaaggtttagtgaattaaatctttttggtaatcaagcttccataacagtttctaatgttggtggtattggtatcactcaagaaatgttaaacttttctgctgaaaaaggtattaaaccaatgattgaaatgattaaagttaaagatattccagaagcatatcaaaaaattattgattgtaaagtacattatagatatgttattga

SEQ ID NO: 26177 - DNA, 954 bp, Neocallimastix californiae
  PKS_ER
tcaaattggtcaaatgaagtatagtgaatgcattggtcttccggcctacactgatgatgaagtggtcattaaggttaagggtgtatccatgcaattcaaagatattatgactgctatggatgctctcattggtttcgatagctatgaaccgggtatggaatgcattggtcgtgttgttgccattggtaagaatgtcgctagcaacccaagaaatcaattacaaattggtgatccagtcattgcattctctcacaaatatggtcatctcttacgtacgtatggtgttgttgatccactctctcttcaaaaaattccagaaagtatgtataaggttgaatatgctggtatctttattgttttcattactgcttattacagtttacatgttcgtgctggtggtattaaacccggccaaactattttaattcacgccgctgctggaggtgtaggtcaagctgccgtgaagttatgtcaactctggggtgctaatattattgccagtgcttctgcttcgaagcaacaattccttcgtgatacttatggtcttgagcatgtaaccaactccagagatccagaagaattctaccgtgatgtgatgaagtggactgatggtaagggcgttgactttgtgttaaactctctttccggaaagagtcttaaaatgggtattaagtgtttgaagaatggtggtaagtttgttgaaattggaaagactgatattttaaatgacagcaagttaggtctacattgtcttcttaataatatctcctttgtctcatcacatattgatcttctcaacaatcaacaaatgaattattacaagaatatcttgtttgaaatgtttagtactggtaagcttactccaattcctgccaagatcttcccaggtaataagtacaaggaagccttcttctatcttgccagtggtagaaatattggtaaaacttgtattga

SEQ ID NO: 26178 - DNA, 948 bp, Neocallimastix californiae
  PKS_ER
tcaaattggtaaattaaagttccgtgaagtctttggtcttccagaatgtggacctgatgaagtaattataaaaattcatagtgttgcccttcaattcaaagatataatgagtgtaatgaataatttaccgggttacaacgtttatgaaccaggcatggaaagtaatggttatgttgttaagattggtgaaaatgcaaagaagcatattcaacttcaaattggtcaaccagtttttgcctttactcataagtatggccatatggtttcaacgtatggtaaagctcactacaaattagttaaaccaatgaacaccaatgatatgaatccagaatcttatagttctgttattgttctcggtactgtcttatatgcccttcgtgatcgtgctggcggtgttaaacgaggtcaaagcattttaattcactctggagctggtggtgttggtcaagcagctattaaattatgccaatattggggtgcaaagatatttgttagtacttcagctaaaaaagtccaatacttgaaggatatgtatggtttagaatacattactaattccagagattcgaagactttttataacgatattatgaaatggacaaataatgaaggtgttgactttgttttgaatgccctcgctggtgatggtattacatatggacttaagtgcttaaagaagggtggtcattttgttgaaattggaaagaagaatattatctttaatactccattaggcttaaaaagtttaatgaacaatattaatttctgttctgctcacattgatttacttgatgtagataagctttctagtttaatgaatgaatcctttgaacttctcaattctggtaagatcactccaattccggtaacattagtaccaatcaagcaatatctttcagccttctttaatatggcctccggaaataatgttggtaagacttgtcttgt

SEQ ID NO: 26179 - DNA, 936 bp, Neocallimastix californiae
  PKS_ER
tagtaatagtagtagtagtagtagtaatggtagtggtagtagtggtcgtgaaagggataaggaatgtgttattgtgaaggtgaaaacgatttctcttcagaataatgatgtccttcaaaattcgtatccggaacttgcagagattatgaagggttccagtgtgattgaatgtgttggtactattgtgaatgttggtagtaaggtaaagaaattcaagagaggcgatttcgtttttggaatcagtttctatggcgattacgttccatccacttatgttaagattccacaagatttagtctttgccgtagatagaaaggataccctgaaacagcaacaacttatttcttccgtttatgcctacacggtagccctctacctcttgaatgaaattcaagccaatgagtcggttcttcttaccactaatgctgtcgatttaatgcaagctctcgtagttattgctcaacagaaacaaatttcaatcgtgttagatgatcgctccaaaaaatacagtcgtagccctaatccaatcttttccaatcttttcaagagtcaacgaatgattcactccgacggagatcgtaatcaatgcgttcaacaggtcaaggccttcaccaataatcagggggttcactatgttattgatgccaatgtaaaatttgatcatgaagaggtattggaagcctgcttaagggaaggaggtgaatacattaaggtaggtaatcttgatcatcatgttaagaagagaacgacacataaggttgttcaaatgagtgccctcagtgtcaaacaaatggcacctttagtaagagaagccattgaaaaaattaataaatgcaccgtagaagctattgaacttaaatcctatccgttgacaaagatgaataatgctaccattgaaatcattagtggtcgtagtcagggtaaatcatgtcttat

SEQ ID NO: 26180 - DNA, 967 bp, Neocallimastix californiae
  PKS_ER
tcaattcagtaattttggagtatcacttgttgaaagaagggctttaagagatgatgatgttgaaattgatattaaatattgtggtatttgtcactcagatattatgatagtacaaaataatcaaccaggaaatggtattgttccaggccatgaaattgctggtgttgtaaaatctgttggtaaagcagttacaaatttcaaagttggtgatcatgttggtataggttgttttgttaactcctgtagtaactgtgaatactgtaaacgtggtgatgaacaattctgtgataaaggtgtagttattgtatttaatagtaaggattatgatggtgcaattacctatggtggttatactcaaactattatagtcagagataaatttgttttacatataccagaatcacttgatttagctatggctagtccacttctttgtgcaggtgttactacttacagtccattaaaacgttataatattggtaaaggatctcgtgttgcaattatgggcttaggtggtttaggccatcttggtgtacaatttgctcatgctatgggtgctgaagttaccgttcttggtcattcagaatccaaaaaagaggaagccaagaaacttggagccgattgttatgaaattttaaagactgatgaagatttcaaaaaatattacagaacttttgattttattttaaattgtgctactgctaatcttagtttagataaccatattaaattattaaaaccaaatggtgtcttatgttttgttagtattgtaccagaggaacaaaagtttactgaaatgaatctttttggtaatcaagctaccataacagtttctaatgttggtggtattgatatcactcaagaaatgttaaacttttctgctgaaaaaggtattaaaccaatgattgaaatgattaaagttaaagatattccagaagcatatcaaaaaattattgattgtaaagta

SEQ ID NO: 26181 - DNA, 948 bp, Neocallimastix californiae
  PKS_ER
tcatatcaatagaatgatgttccataaagaatatggtattccggaacttaagaaaagtagtgaaaaggacaatgagagtgttgttgtgaaggtcagaatgatttctcttcaaaataatgatgttcttcataactcttacccagaactcgctgatatcatgaagtgttctaatgtggtagaatgtgtcggtaccattgttaatgttggtagtagagttaagaacttcaaaagaggtgattttgtttttggtattagtttctatgctgactacgttccttcctcctacgtcaagattcctcaagacttggtggttgttatcaatgaaaaggatagtcagaaacagcaacgccttatttcctcagtttatgcttatactgttgcactctatttattgaatgatattaaagaggatgaatctattcttttctctacaggtgccaatgatttaatgcaagctctggttactgtagctaaacaaaaacgtattcccatccttttggatgatgtctctcaaaaatacagtagaagtggtaatcctatctttaccaaccttcttaaggatcaaagaatagtaaattctggagatcatgaccaatgtcttcatcatgttaaacagttaactaatggtcatggagtccactatgtcatcgacgccaatgtcaaatcggacagagaaaatgttttgaaggaatgtctaagccataaaggtgaatatattagggttggtcattttagtcaaaatgttattaaaaagagtatatccaatagagtcattcaaatgaatgctcttagtaccaaggaaatctcaccaatagtaagaaaggctatagaaatgattaatgactattctgtggaagccattgagctcaaaacctatccactctcacagatgaatcgtgccatccttgaaataattagtggtcgtagtcagggtaaatcctgtcttgt

SEQ ID NO: 26182 - DNA, 1005 bp, Anaeromyces robustus
  PKS_ER
tcaaccaaaagatgttttaagtttaaaagaactaaaaatttccaaaattaaagataatgaagttttagttaaatttttagcttctccaattaatccttctgacataaatcaaattgaaggtgtctatccaataaaaccaagatttaaagaatttggtgctgttggtggaaacgaaggtgttgccgaggttattgctgccggtccaaaagtcaagaatttagttgtcggtgactgggttattcctgacactaaagcttttggtacttggcaaacttttgccgctagtccagaaaatgaattccaaaaaattaacaaaaatggtatttcaaagattagcgcagctactatatctgtaaacccaccaactgcttatagaatgttaaaagattttgttaatttaaagaaaggtgatgttgttatacaaaatggtgctaatagtgctgttggacaatctgttattcaaatcgccaaggcctggggtatcaaaacaattaatgttgtccgtgatagaccaaactttgatgaatttgctgccgaattacataagcttggtgcaactttagttattaaagaagaagatttacgtgctaattctactcgagaacttgtaaaaaacttaggtaatccagttcgtttagccttaaactgtgttggtggtaaatctgcttctggtataacccgtttacttggtaataacgctacaattgttacctatggtggtatgtctaaacaaccacttactttcggaactggtccatttatcttcaaaaatttacgtgcttgtggtttctgggtttctcgttggaataaagaagcttcaaaaaaagataaacaatatatgtttgatgatatttgtgaacttattcgtggtggtcatttagctgagccatggcatgaagaaaccaaatgggaaactagtgatgataataaaactttaaataagaagttcaagagtgcccttagtaaagctggtgctagctttggtaacagaaaacaaattttaac

SEQ ID NO: 26183 - DNA, 996 bp, Anaeromyces robustus
  PKS_ER
tactgttgataacatgaaagtagttaaaagtccagttccagaattaggtgaaaatgatgtattacttaagaacctttgttgttctattgacccattcatgcgtggtcgtatgagagaaaatgttaagtcttatgttccttcttttgaaaagggaaaggttatgcaagttttttctgttactcaagttgaaaaaattggttctgctgttactgatattaatgttggtgataaatatatgtgtttcaatggtattgaaaaatacaccgttcttccacaacaagttattaaaggtgacggtaaacaatctcttggtagtttcaccaaaattgatcaaagaaacccaattaaggattccttctatctcggtttattcggtatgccaggtatgactgcttgggctttcttcaacaaggtcggtaagccaaaagaaggtgaaaccatctttattactgctgctactggtgctgttggtcaagttgtttgtcaacttgctaaacttaagggtttaagagttgttgcttgtgcttcatctccagaaaagattggtttcttaaaacaagctcttaaggttgatgaagcttttagttaccgtgacttcccagacaagaaatcttttactgaacaattacgtaaggtttgtccaaatggtattgatatctattacgataatgttggtggatacattcttgattctgctcttgaagttatgaacattcatggtagagttattatgtgtggtatgatctctcaatacaaccttaaggacaaataccaatacactcttagagatattacttccagaagacttactcttcaaggttgtttattcaatgatttcttcccacaatgtatgggtgaatttatgcaagatatgattccaaagttagaaaagggacaaattatttacaaggaagatatttatgaaggtgttgaaaaggcaccagaagcctttattggtttattcaacagtaataactttggtaaggttgttattgt

SEQ ID NO: 26184 - DNA, 948 bp, Anaeromyces robustus
  PKS_ER
tcaaattggtaaattaaaattccgtgaagtctttggtcttcctgaatgtagtccagatgaagtagttattaagattcatagtgttgctcttcaatttaaggatgttatgagtgtcatgaataacttaccaggttataatgtttatgaaccaggtatggaaagtaatggttatgtcgtaaagattggtgaaaatgctaaaaaacatattaacctaaaaatcggacaacctgtctttgcctttactcataaatatggtcatatggtttcaacctatggtaaagctcattataaattagttaagccaatgatgaataatgatatgaatccagaaaattacagttctgttattgttcttggtactgttttatatgctcttcgtgatcgtgcaggaggtgttaaaccaggtcaaagtattttaattcaatctgctgctggtggtgtaggtcaagctgctataaaattatgtaaatactggggtgctaaaatttatgttagtacttcaacaaaaaagagagaatatttaaagaatttatatggattggagtatattactgattcaagaaatccaaagattttctatgaagatattatgaaatggactaataatgaaggtgttgactttgtccttaatgctcttgcaggtgatggtattacctatggtttaaaatgtttaaaaaaaggtggatgttttgttgaaattggtaaaaagaatattattttgaatacaccattaggcttaaagagtttaatgaataatattaatttctgttctgctcatattgatttacttgatgttgacaaattgtctagtttaatgaatgaatcttttgagtttattaatacaggtaagattacaccaattccagtaactcttgtaccagtaaagaaatatctttctgcattctttaatatggcttctggtaataatgttggtaaaacatgtattgt

SEQ ID NO: 26185 - DNA, 735 bp, Piromyces finnis
  PKS_ER
accaaaagatgttttaagattaaaggaacttactattccaaaaattaaagatgatgaagttttagttaaatttttagctgcaccaattaatccttccgatattaatcaaatcgaaggtgtttatccaattaagccaagatttaaaaagtatggtgctgttggtggaaacgaaggtgttgctgaagtcgttgctgctggtaacaaagttaaaaatttaactgttggtgattgggttattccagatactaaagcttttggtacttggcaaacttttgctgctagtccagaaaatgaattacaaaaaatcagtaaaaatatttcaaaaattagtgctagtactatttctgttaatccaccaactgcttacagaatgttaaaagacttcgttaacttaaagaaaggtgatgttattattcaaaatggtgctaatagtgctgttggtcaagctgttattcaaattgctaaagcatggggaattaagactattaatgttgttcgtgacagaccaaactttgatgaacttgctgatcaattacataagcttggtgccactttagtcattaaagaagaagacttacgtgctaacagtactcgtgaacttgttaagaatttaggaagtccagttcgtttaggtttaaactgtgttggtggtaaatcagccaatggaattacacgtttacttggacataatgcttctcttgttacttacggtggtatgtccaagcaaccacttac

SEQ ID NO: 26186 - DNA, 948 bp, Piromyces finnis
  PKS_ER
tcaaattggtaaattaaagttccgtgaagttttcggtttaccagaatgtggtccagacgaaattattattaagattcaaagtgttgcccttcaatttaaagatattatgagtgtcatgaataatttaccaggttacaatgtatatgaaccaggtatggaaagtaatggttatgttgttaagattggtgaaaatgctaagaagcacgttaatttcaagattggacaacctgtctttgcctttactcataaatatggacatatggtttctacctatggtaaagctcactataagttggttaagccaatgatcaataatgatatgaatccagaaaactacagttctgttgttgtcatgggtactgtattatatgctattcgtgatcgtgctggtggcattaaaccaggtcaaagtattttaattcagtcagcagctggtggtgttggtcaagctgctattaaattatgtcaatactggggtgctaaggtatatgtcagtacttctgctcgtaagagaaaatacttggaggacttgtatggattagaacacattacagattccagaaatccaaagactttctatgaagatattatgaagtggaccaacaacgaaggtgtggactttgtcttaaatgctcttgctggtgatggtattacctatggtcttaagtgcttaaagaaaggaggtcgtttcattgaaattggaaagaaaaacattattatcaatactccattaggtttaaagagtttaatgaataatatcaacttctgctctgctcatattgatttattagatgttgacaagctttctagtttaatgaacgaatcctttaaacttatcaacaccggtaaaattacaccaattccagttacccaagtcccaattaagaagtacctttctgccttcttcaaccttgcttctggtaacaatgttggtaagacttgtattgt

SEQ ID NO: 26187 - DNA, 936 bp, Piromyces finnis
  PKS_ER
taatattaataagacaatcttcagaaaaacttatggaattcctgacctttccaaacatgaaatggataaggagagtgttgtggtaaaagttagtacaatttctcttcaaaataatgatattcttcaaaattccttaccagatctttcaagtcttatgaaggattccagtgttgctgaatgtattggtactattgttcatacaggttctaatgttaaaaactttaaaaaaggcgatgttgtctttggtttgaatcttcaggcaaatgatattccatcaacatacgttaagattcatcaagatttggttttcccagtgaatactatggatatggataagcaaaataaccttctttcatctgtttatgcttacaccgtagctatttatcttttaaatgaaattccaacaggtgaatctgtccttatttcaacggatgcaagtgatttaatgcaagctttagctaccattgctcaacagaaaggtattaacctctttatcgatgatacatcttcaaaatacagtaaagctaatagcaatgccttcaagaatattaaagcccaaatgataaatactcgtcaagcatccgaatacgttcgtcttgtcaaacaacatacgaatggtgaaggtgttggtgttattattgacattaatgtaaagtttgataaggaaaacacactagaaaaatgtttaagaattgatggtgaatatatcaaggttggaaatattgatcaaagtaccaagaaaagaactacccataagatagttcaaatgagtcattttaaggataatgtcattactccagtagtccgtcaagcagtggaaatgattattcatggtaaggttgaagccattgatcttaagacatatccagtttctaaaataaattctgctacacttgaaatattaagtggtcgtcttcaaggtaaatcttgtcttga

SEQ ID NO: 26188 - DNA, 954 bp, Piromyces finnis
  PKS_ER
tcaaatcggtcaaatgaagtttaccgaatgtatcggtcttccaaagtataatgatgaccaaattgttataaagaccaagggtgtttctatgcaattcaaggatatcatgactgccatggataccttggttggttttgatgactatgaaccaggtatggaatgtattggtcgtgttgtagctattggtaagaatgttgccagtgatccaaagaatgtattacaaattggtgatccagtcgttgcttttgcccacaagtatggtcatcttcttcgtacctatggtgtagctgatccactttccgttcaaaagattccagaaagtatgtacaaggttgaatatgctggtatctttattgttttcattactgcttactacagtttacacgttcgtgctggtggtattaaaccaggtcaaaccattttaattcatgctgctgctggaggtgttggtcaagctgctgttaagttatgtcaactctggggtgctaacattattgcctcagcatcagcttctaaacaacaattccttcgtgacacctatggtattgaacatgtcaccaactctcgtgatccagaacaattctacagtgatgttatgaaatggaccaatggtaagggtgttgactttgtcttaaactctctctctggaaagagtctccgtatgggtattaaatgcttaaagaacggtggtaagtttgttgaaattggaaaaactgatatcttgaatgatagtcaattaggtttacattgtctccttaacaatatttccttcatttcttctcacattgaccttctcaacaaccaacaaatgagtttctacaagaacattatctttgatatgtttaaaaccggaaaacttactccaattccagccaagatcttctcagctaacaaatataaagaagccttcttctatcttgctagtggtagaaatgttggtaaaacttgcattga

SEQ ID NO: 26189 - DNA, 564 bp, Neocallimastix californiae
  PKS_KR
tacgattttaattaccggtggtcttggtggtgtcggtttcgatatttctcgctacttgatgagacaacccaaccttaaggctcttgtacttactggtcgtagaccagaaacggatgaaaaggtagccggtaagttagccgaacttcgtgccctcaatccaaagattaaaattacctatgttaccgccaatgttggttctgaaaccgagatgaagaaggtcattgacgatattaacgctggaagtccagaagaagctttagttggtgtcttccacacagccggtactaatgatgatggtttaatctttaaccaatcgtatgaacgttttgccaagttaattaatagtaagattgaaggtacactttgtattgctaagcttactaatgatttgaacttgaagttcacaatactcttctcttcgatgaccgccttctttggtaatcgtggtcaaattaactactgtaccgctaatatgtttattaataaggtctgtgactactaccgtaatcatggtcgtaaggatattctttctcttgaattggcaggttggccatctggtctttc

SEQ ID NO: 26190 - DNA, 570 bp, Neocallimastix californiae
  PKS_KR
ggttgttattattactggtgctggtggtggtctaggtcgtgcttacgctaaacattttgctaaattaggtgcttctgttgttgttaatgatttaggtgtccttttacgtggtagaggtgctaacactcaagttgctgatagtgttgttgaagaaattaagcaaatgggtggtattgctgttccgtcttatgattctgttgaagaaggtgaaaagattgttgaaaccgctattaagaactttggtcgtgttgatattattattaataatgctggtattttaagagatagatcttttggtagaatgactgatactgattggatgatgacatatagagttcacttaaagggtacttataaggttacaagagctgcttggccatacatgatgaaacaaaagtatggtagaattattaatattacttctgcggctggtctttttggtaactttggtcaatctaattatgctgctgctaaatctggtgttattggtctcactaatgcattagctttagaaggtaaagagtataatattactgtaaatagtgttgctccaaatgctggtactagaat

SEQ ID NO: 26191 - DNA, 570 bp, Neocallimastix californiae
  PKS_KR
agtagttattgttactggtgctggtggtggtcttggtcgtgcctatgctaagcactttgctaaattaggtgcctcagtcgttgttaatgatttaggtgtccttttacgtggtagaggtgctaacacacaagttgctgatggtgttgttgaagaaattaaaaagatgggtggtattgctgttccatcctatgattctgttgaagaaggtgaaaaaattgttgaaactgctataaagaactttggtcgtgttgatattattattaataatgctggtattttaagagatagatcttttgcaagaatgactgatactgattggatgatgacatacagagttcatttaaaaggtacctataaagttactagagctgcttggccatatatgatgaagcaaaagtatggtagaattattaatattacctctgctgccggtcttttcggtaactttggtcaatctaactatgctgctgctaaatctggtgtcatcggtctcactaatgccctagctttagaaggtaaagaacataatattactataaatagtgttgctccaaatgctggtactagaat

SEQ ID NO: 26192 - DNA, 582 bp, Neocallimastix californiae
  PKS_KR
taatattcttattactggtggtttaggtgatgtaagtatggatgtcgttaattctctcctagctgacaaggacagtaaattggaacacattttccttctcggtagatccagtaagactaacagtagagttattgaaaagttagctcgtattgaaaaggtaaggaaagatcatgataaaaatattcaaattgaatattattcttgtgatatttctgatgaatcctctcttgctgaagtattcaatgatattcgtaaacgtcaaggcttacaaattactggtattttccatactgctggtgtcaacagtgatgccaacttcttaagccaatcctatgaaaaattagttgaaattgctccttcaaagattattggtactcataatattatgaaactttctgaagaatttaaggatgaacttaagtttgttgtctttgtttcatccctttctgctgttagtggtaacggtggtcaaactaactatactgctgctaatatgttcattgatgcgcttgctagatattataatgaccacggaagaactaatgtcatcgccatcgaactcggtggttggaagggagctgg

SEQ ID NO: 26193 - DNA, 540 bp, Neocallimastix californiae
  PKS_KR
aacctatttaattactggtgcttttggtggtgtcggtttaagagttgttctttggctagttagccgtggtgccaagaacattttattaaccactagtagttctgttgaaaaacaatatgaacaaccaattattagatctttattggaaaagggtattaatgtaatgattaagacctgtgatattactgatttgactagtgttcaacaattattccaacaaactactccaagaattgctggtgtcttccatttagcaaatcgctttgctccaggtttaattagtacttccgatcttgctttgcttcgtaagggcttcagtgctaaggctgaaggtgcatggaatttacacttggttactcttcaaaaggctcatcaagttcaattgtttgttgtcttttcttccattcttgatgttttaggtaatcgtggtcaaactgcttatggtgctgctaatgctttcttaagttctattgttgatcatcgtagagaaaaaggtctctctggtaattgtattgctcttccagctatgcgtggttctgg

SEQ ID NO: 26194 - DNA, 534 bp, Neocallimastix californiae
  PKS_KR
agcatatttaatcactggagctttcggtggtgttggtttacgtgttgctgaatggcttcagttaagaggtgccaagaatattgttttaactacatctggtaatatagaaaagcgtaacagaaaccctattgtggaaactcttcgtagtaaaggtgtccatgtgacagttacccaatgtgacatttcaaatattcatgctgtccgtaagttattccaagaaacaacaccacaaattgctggtattttccatctagctaataaatttgctcctggattgattcaaagaacttcccttgaacaattccatgttgcttataatccaaaagcaagaggtgccttaaaccttcatttagttagtaaagattatccaatagatatgtttgttatgttttcttctgttcttgatcttttaggtaataagggccaagctgcttatggcgcagctaattccttccttggttccttagttgaacttcgtcgttcgcaaggtttatgtggttcatgcctttccttgccagcgatgaagggttccgg

SEQ ID NO: 26195 - DNA, 537 bp, Neocallimastix californiae
  PKS_KR
atcctatttagttacaggagcctttggtggtgttggtttaagagtttgtctttggatgcaacttcgtggagctcatcatcttgtattgaccacttcttctaatcctgaaagtaaaaaggatcatccgatagtgaaggccttacgtcaacgtggcgcgcaagtctcgattgttaaatgtgatatatccaagtatgatgaagtagaaaagctctttaaggaaaccagtccatccctggatggagttttccactttgctaataaatttggaccaaaacttattcgtgattctggtcttgaaagctttattgccacctatgaacctaaagctcgtggagctcttaatcttcataagattagtcaaaagggttatcctctctccacctttgtcctcttttcctctgtcctcgatcttctcggtaataccggtcaaattgcctatggtggagccaatgccttcctcggtaatcttgtatattaccgtagaagacaaggactctctggtcaatgcttctccttacccgccatgaaaggttcagg

SEQ ID NO: 26196 - DNA, 567 bp, Neocallimastix californiae
  PKS_KR
taccgtcttaattactggtggtactggtggtgttggtttcgatatctgtcgctacctcgttaaacaagctaaccttaagggtcttgtccttactggacgtcgaccagaaaccgatgaaaaggttgctggtaggttagccgaaattcgtgcccttaatccaaagattaagattacctatgtcaccgctaatgttggttctgaacaagaaatgaagaaggtctttgatgatattaactctggctctccagaagaagcccttgttggtgttatccatactgctggtaccaacgatgatggtttaatcttcaaccaatcctatgaacgtttcgcaaagttaattaacagtaagattgaaggtgctctctgcattgctaagcttacggaaggtttgaacttaaagttcaccattctcttctcctccatgacggccttcttcggtaaccgtggtcaaattaactactgtacggctaacatgttccttaacaaggtttgtcagttctaccgttcccacaacggtcgcaaggatattatgtctcttgaattagcagcctggccatctggtcttag

SEQ ID NO: 26197 - DNA, 537 bp, Neocallimastix californiae
  PKS_KR
atcttatttggtgaccggggcttttggtggtgttggtttaagagtttgtctttggatgcaacttcgtggagctcatcatctcgtccttactacctcctctaatcctgaaatgaagtatcatcatccaattgtgaatgccttacgtcagcgtggtgctgaagttaccattgtgaaatgtgatatttcaaagtataatgaggtggaaaaactttttaaggaaactactccagtgattgatggtgtcttccattttgctaataaattcggaccaaaattaattcgagattccaacctttcaggttttatctccacctatgagcccaaggcacgtggagcgctcaatcttcataaagttagtcaacagggttatcctctctccaacttcgttctcttctcttctgtattagatcttcttggaaataccggtcaaattgcttatggtggtgccaattctttccttggtaatcttgtctattatcgtagaagtaaaggactttcaggtcagtgcttctccttaccagcaatgaaaggttctgg

SEQ ID NO: 26198 - DNA, 570 bp, Anaeromyces robustus
  PKS_KR
agttgttattgtaactggtgctggtggtggtcttggtcgtgcttacgctaagcatttcgccaaattaggtgcttctgtcgttgttaacgatttaggtgtccttttacgtggtagaggtgctaacactcaagttgctgatagtgttgttgaagaaattaagaaaatgggtggtattgctgtcccaagttatgattctgttgaagaaggtgaaaagattgttgaaactgctattaaaaactttggccgtgttgatgtcattataaataatgctggtattttaagagatagatcatttgctagaattactgatactgattggatgatgacttataaagttcacttaaagggtacctataaagttactaaggctgcttggccatatatgataaaacaaaaatacggtagaattattaatattacttctgctgctggtctttttggtaactttggtcaatctaattatgctgcagctaaatctggtgttattggttttaccaatgctttagcattagaaggtaaggaacacaatattactattaacagtgttgctccaaatgctggtactagaat

SEQ ID NO: 26199 - DNA, 582 bp, Anaeromyces robustus
  PKS_KR
taatttacttattaccggtggtttaggtgatattagtattgatatcatgaaatatttcttttctttagatcattgtaaattagatcatattttccttattggtagaagtagtaaatctagtgccaaggtcaatgataagttagctcgtcttgataaatctatgaaggataatggtaaaaatattgatattcaatactatccatgtgatatctctaatgaagctgcacttgctgaagttttcaatgatattcgtaaacgtcaaggtttacaaattaatggtattttacatactgctggtactaatagtgatgcctctttcattaatcaaacttatgataaattagttgaaattgctccagctaaaattcatggtactcataatatcattaaacttactgaagaatttaatgatgaaataaagtatattgttttattttcttccattactgctctttctggtttctcaggtcaaaccaattatactgctgttaatttattcattgataatattgctaaatattgtaaaaaccatggtagagacaatgttatgtctattgagttaactatttgggaaaatgctgg

SEQ ID NO: 26200 - DNA, 558 bp, Anaeromyces robustus
  PKS_KR
tactattttaattactggtggtctcggtggtgttggttatgatgtttctaaatatcttattaccaaaccaaatcttaaagctcttgttcttactggtcgtagaccagaaacagatgaaaaggttgctgctaagttaaatgatcttcgttctgctagtaaaaatgttaaaattatttatgccgttgctaatgttaattctgaagaagaaatgaaaaaattatttgatgatattgctgcttcagaaaatccattaactggtataattcatactgctggtactaatgatgatggtttaatctttaatcaatcctatgaacgttttatgaaattagttcctggtaaggtagaaggtccacttattattactaaacttactaaggatataccaaatttaaaattcactattcttttatcttctatgagtagtttctttggtaatcgtggtcaaattaattataccactagtaatgtatttattaataaactttgtcgttactaccgtgctcatggtagaaaggatatggttgctttacaattagctgcctggccatctggtct

SEQ ID NO: 26201 - DNA, 534 bp, Anaeromyces robustus
  PKS_KR
atcttatttaattactggtgcttttggtggtgttggtttacgtgttgctttatggcttcaattaagaggagctaaaaatattattttaacaacttcaggtaatgctgaaaaacgtaataaaaatccaattgttgaaggtcttcgtaataaaggtgttaatgttttagtacgtcaatgtgatatttctgatattaatgctgtacgtaaattattccaagaagctaatccaccaattgctggtatattccatcttgctaataagtttgctccaggtttaattgaaagaacttccttagaacaattccatgttgcttacaatccaaaggcaagaggtgccttaaatcttcatttagttagtaagaattatccagttgatatgtttgttatgttctcatctgtacttgatcttttaggtaataagggtcaagctgcttatggtgctgctaattccttccttggttctttagttgaacttcgtcgttctcaaggtttatgtggttcttgtctttctttaccagctatgaaaggatctgg

SEQ ID NO: 26202 - DNA, 558 bp, Piromyces finnis
  PKS_KR
tactattttaattactggtggtcttggtggtgttggttacgatatctctcgtttccttatgaaacaaccaaaccttaagggtcttgttcttactggtcgtagaccagaaactgatgaaaaggttgctgctaaattatcctccattcgtgaagttaataaggctattaaggttacctatattactgttaatgttggttctcaaactgaaatgaaagaggttattagtggtattaaggctagtggtagtaaattaactggtattattcacactgctggtgttaatgatgatggtttaattttcaaccaatcctatgaacgtttcgccaaattaattaacagtaagattgaaggttctcactgtatcgctaagattactgaaggtatgaacttggaatttattcttctcttttcttctatgacttccttctttggtaatcgtggtcaaattaactattgtgttgccaatatgtttgttaataaaattgctcactactaccgtagtcacggaagaaaggatattatcactttacaattagctgtatggccatccggtcttac

SEQ ID NO: 26203 - DNA, 534 bp, Piromyces finnis
  PKS_KR
atcatacatcattactggtgcttttggtggtgttggtttacgtgttgccttatggcttcaattaagaggtgccaaaaacattgttttaactacctctggaaatgctgccaaacgtaataagaacccaattgttgaaggtcttcgtagtaagggtgttaacgttaccgtttgtcaatgtgacatttcaaatattaatgctgttcgtaaattattccaagaaactactccacaagttggtggtattttccatcttgctaacaaattcttaccaggtttaattccaagaacttcattagaacaattccatattgcttacgatccaaaggctaaaggtgctttaaatcttcatcttgttagtaaggattacccaatagatatgtttgtcttattctcttctgtccttgatttattaggtaataagggtcaagctgcttatggtgctgctaattccttccttggttctttagttgaattccgtcgttccaaaggtttatgtggttcttgtatttctttaccagccatgaagggatctgg

SEQ ID NO: 26204 - DNA, 582 bp, Piromyces finnis
  PKS_KR
taatcttttaatcacaggtggtttaggtgatgttagtatggatgttattgaaaatttgttatctgataaggaaactaaacttgaccacatcttccttttgggtagatctagtaaaactagtactaaggttgaagataaattagatcgtattgaaaaaattaaaaaggccaataataagaaaactgaagttgaatactattgttgtgatatttccaatggagattcattaaatgacgtattcaatgatatccgtaagcgtcaaggtttacaaattaatggtatcttccataccgctggtactaatgatgatactttattcttaactcaaacttacgaaaagtttgaaaaattagctccagctaaggttattggtactcataatattattaagtacacagaagattttaaggatgaattaaagtttatcattttaacttcttctcttactgccctttctggtttaactggtcaaaccaattatactgctgctaacatgtttattgatgccattgctagatattgtagaaaccatggaagaaataatgttatgtctttagaactttgtggttggtctggtgcagg

SEQ ID NO: 26205 - DNA, 537 bp, Piromyces finnis
  PKS_KR
atcctatttgattaccggtgcttttggtggtattggcttaaaagttggtctttggatgcaacttcgtggtgctcgtcatattgtattaacaacatcgtctgatccagagagtaaatataagcatccaattgttaatgctttacgtcaaaaaggtgttcatgtcaccattactaaatgtgatatttcaaagtatgatgaagttgaaaagcttttcatggaaaccacaccagcaatcgatggtgttttccatttcgctaataaattcggtccaaagcttatcagggattctagcctagatagttttaatacagcatttgaaccaaaagcaagaggtgcattaaatcttcataaaataagtcaaaaaggattctcactttcttcctttgttcttttctcctctgttttagatattcttggtaattctggtcaaatggcatatggtgctgcaaattcttaccttaataatcttatttattatagaagacgtaaaggtctttctggtcaatgcttctcattaccagccatgaaaggttctgg

SEQ ID NO: 26206 - DNA, 540 bp, Piromyces finnis
  PKS_KR
aacctatcttgttactggtgcctttggtggtgttggtttaagagttgttctttggttagttagccgtggtgcaaagaaccttttattaactactagtggatcagttgaaaagcaatatgaacaaccaattattcgttctttaattgaaaagggagtcaatgttatgattaagacctgtgatatcactgattacaacaatgttcaacaattattccaacaaactcaaccaagagttgctggtgtcttccatttagctaatcgttttgctccaggtttaattagtacttctgaccttgctttacttcgtaagggctttaatgctaaggctgaaggtgcttggaacttacacaaggttactgctcaaaagcaacatcaagttcaactctttgttgtcttttcttctattcttgacgttttaggtaaccgtggtcaaaccgcctatggtgctgctaatgccttcttaagttctatcattgatcaccgtagagaaaatggtctttctggtaattgtatcgctcttccagctatgcgtggttctgg

SEQ ID NO: 26207 - DNA, 558 bp, Piromyces finnis
  PKS_KR
agttgttattgttactggtgctggtggtggtcttggtcgtgcttacgccaagcactttgctaagttaggagcttctgttgttgttaacgatttaggtgtccttttacgtggtagaggtgccaatactcaagttgctgatagtgtcgttgaagaaattaagagtatgggaggtattgctgttccaagttatgactctgttgaagaaggtgaaaagattgttgaaactgccatcaaaaactttggtcgtgttgatgttatcattaacaacgctggtattttaagagatagatcctttgctagaatgaccgatactgattggatgatgacctacaaggttcacttaaagggttgttacaaggttactaaagctgcttggccatacatggttaaacaaaagtacggtagaattattaatattacatctgctgccggtcttttcggtaactttggtcaatctaactatgctgctgctaaggctggtgttattggtctcactaatactttagccttagaaggtaaggaacacaatattactgttaatagtattgctccaaatgc

SEQ ID NO: 26208 - DNA, 1314 bp, Neocallimastix californiae
  PKS_KS
tgctgttgttggtattgctttaagacttccaggtggtatcaataccgttgataagtattggaagagtttagaaaatggtagattttgtgtctctccaacaggtactaaccgtcatcttcaccataacatgactcacaatgaggaactaaaaccaggagaacattacattttcaactactgtcgttatgatagtactccagatgcagctcctatcactgattttgatccaatgttctttaatatgaatccaaatgaagccactgttcttgatccaaagttccgttgggtcttagaaactacttatgaagttttacaagatgctggtattaacccagattctctctctggtactcatactaatatttacactgcccctggacaagttgatgaaatgaatgcttatgctactaatgcctctccaactggttacagtgttcttaatggtatgagtatgcatagttgtgcttctgcttccttaccaggtagaattagtttcatgtataatttatttggtgctgctcacaccgtagatactgcctgttcttccggtttagttgctatccatgatgcttttaaggatttgaatattggtgaaactgatcttgccattgtgaatgctgctcactgtccattccaaagttcttctttcagtcttttatcaatagcaaaaatggtttccagaaactgtagatgtgcttcttacgatgaagcagcagatggttacgttccaggggaaggttgtgtttccgttattttaaagagaaaggatgatgccattcgtgatcataataagatttatggtttaattaatgctactgctgtcggtcaaagtggttccagagcttctatgagtactccaacggttctcggtcaaaagtacattcataaaaaggtccttgaaaaggctaatcttactccaggagatattgattatatggaaggtcatggtactggtaccaaattgggtgatcgtattgaagctgaagctattaatgaagttttcaagggtactcactctgagagccgtccattaaccttagctagtgtaaagactaacattggtcacactgaagaagttagtggtttagcttctttggttaaggttttattagcaatgaagcataagaccgttcctcctcatcttcacttcaataagccaagtcctttgattgattttgattccgttccattacacattccaactcaaaaggaagaatggaagccagctgaaggaaagaaacgtgttgctttagtttcttcctacggtctttcaggtagtgtctgtgatgctatcgtagaggaatacattgatcc

SEQ ID NO: 26209 - DNA, 1317 bp, Neocallimastix californiae
  PKS_KS
tgctgttgttggtatgggtcttcgtttaccaggtggtattaatactccttctaaatattggaatgctttagttaatggtaaggattgtatttcaccaactcctgctaaccgtcatcttcaccaatatttaaggccattttgcccaccaaatgaattaggcccatttgatcactatattcatcgtgctggttattatgatgttactccagatgctgccccaatttctgattttgatccaactttctttaatatttctccattagaagctaaattcactgaaccaaaattccgttggatctatgaaactgtttatgaagctttccaagatgcttgtataaatgtttctgaattaaatggaactcgtacttctgtttttactactgttggttctactgctgattatattgctttaactaaggcttttactaaagttgaatcaatgactagtcaaactatgcatggttctgctgcttctagttgtgctggtcgtatttccttcaactatggttttattggtccatctgatactattgatactgcttgttctagtggtttaaatgattgtcacaatgcttgtaaatcactttctatgggtgattctgatgtagctgttgtttctgctgttcaccaacaatttgtatctactcaattccatgttatttctgttgctcatatggcttcacaaattggtcgttgtgctacttttgatgctgaagctgatggttatgctcctggtgaaggttgtattagtattattcttaaacgtttagatgatgctgtaactgatcatgatcatatttatggtgttattactggtattactacttcacaatctggtattagaccatctatttcttctccagcggttggtccacaagttgagaatattcaaaaagctttacaaattgctaatgtttctccagctgatgttgattatgttgaagctcatggtactggtacccaagttggtgatgctattgaaactgaaactttaaacatagcctttggtggtactcacaatgctaagaagccattaattgtaggtagtgtaaagactaacataggtcacactgaagaagtttctggtttagctggtttatgtaaggttcttttatctatgtctcatcgtactattccaccacatcttcacttaaagaatttaaatccacgtattgatacctccgttattccaatgaccattccacaaaagaaatgtatttggaagagtccacgtggaaagaagagagttggtgttgtttcttcttttggtttacaaggtagtgttgctaatgctgtaattgaagaatttaaacttcc

SEQ ID NO: 26210 - DNA, 1284 bp, Neocallimastix californiae
  PKS_KS
tgctattattggtattggttgtcatttcccagaaggtatagagtcaaaggaagctttctggaaaatgttagaagatgctcgttgtatcacaaaggatatacccaaggatcgatgggataaaaatgaatggtattctaaggaacctattcaaggtacaattcaaactaaacgtggagccttcctaaaaaacccatatcttttcgataataagtatttctatatctctatgccggaagctaaagaaatgtcaccggaacaacgttggcttttagagttaactgtagaaaccttagaagatgcaaacattaaacctgaagctgtccgaggatcacgtacgggtgtcttcattggatcttctggttgtgattatttagccactcaaatttctcatgccaatgatattaattctcattctcctactggatttgaactttctattttagctaaccgtttatcctatgtttttgatttacaaggaccctccattagttgtaataccgcttgttcttctgcattttctgctttaaatatcggtttaaatgctatgattacggatgattgtgaaatggctctcgttgctggttctaattttatgaattgtccaggtggatttgtggccttctctcaacttcgtgtcgtttctcctgacggttcctgtaaaccttttgatgaaaaggctaacggttatgccagattagaaggagctggtatggtattaattaaaccctatgaaaaggccgttcgtgatggtgataaaatttattgtgctatcgttggttgtggtagtaatgaggatggtcgttctccctccctgactatgccatcctatgaagcccaatataagcttttaagtcatgtttgtgaaaaatcaggcatacttccatcagaaattgattatgtggaggcccatggtactggtactaaagtaggagatccaattgaatcccatgccattggagatgcctatggtcgtagtaaaggggttcgtggaccaaatgatccccccgtcctcgtaagttcagtcaagggtaacacaggccatggtgaaaattcgagtggtattgttagtatcataaagacctcattgatgctccataaacgtaaattagtacccaccgttgcttatcatcatatgaaccctgccattgatgctgaaaaattaggaattaaggtatgtgaaactttagaggattggaaaacgcctcatacccttcatgctgctgtcaattcttttggttttgggggtgccaatacaaatacgattttggaagaggtaaaacatct

SEQ ID NO: 26211 - DNA, 1266 bp, Neocallimastix californiae
  PKS_KS
tgcaatcattggtatggcttttcgtttacctggagctattagtaattctaaatcattatggatggctttagctaaaagtagggattgcatcttacctccagtgaaaactagagatttacatcatggctatgtgaataagccagccaatcaattaggccccaaggaacactaccttgctcgtgtgggttgttacgatgttcgtcctaacgtggctaaaccttcagaattcgatgcagacttctttaactgttcaccggaagaagctactgctcttgatccaagacatcgttggatcttagaaacgagttgggaagctttagaaaatgctggtattgtaccaagctcgcttaaaaataccatcactggagtctttgtcggtatgaacaatgatcatgaacatgaagatctattaaagaaatgtggtaaagttccaccgttagccgctcatgccaccgctcaaagtagtattgccggtcgtctcagctatttctatgaactctttggtccttcctacaccatcgataccgcctgttctacaggttcctctgcccttcattctgcttgtcagtctatgcaatgtggggactgtgatctttctatcgtttctggcgtaaagtatatgtattccagtgatgaattccataagacttgtgcggctcgtatgacttcgccgaatagtcgttgtgctacctttgacgccagtgccgatggtttcgctcaaagtgaaggttgtgtgacctttgttttaaaacgtcttgaggatgccattcgtgataaggataacatcttatcggttatcctgggttccagtagtggtcaaagtggtttaagacaatccattagtgctccttcctcggaaggtcaaagaattacgattcagagagccatgaaggtcgccggtatcactccagatcaagtctcctatgtagaggctcatggtacgggtacccccttaggggatgccatcgaggttcatgcgctcaatcaagtctacgccggtagtcacacggaagaaaatccattagttgttggtagtattaaatctaatattggtcatacctgtgaagctgctggtttagcaggtatcgctaaggttattgtggccatgaagcataatactattccaaagaatattcatttcaatgaacttaatccggagattgacctcagcgtgattccaatgaaaattccaaccaagaatttaccatggaattcttctgaggaaggaaaacctttaattgctcaagtatcctcctttggattaca

SEQ ID NO: 26212 - DNA, 1329 bp, Neocallimastix californiae
  PKS_KS
tgctgttattggtgttggttgtcgtttcccaggtaatattaaatctaaggaagatttctgggaaatgcttacttcaggtcgttgtcttacttcagaaataccaaatgatcgatggaatactgcggaatggtataacaaggaaccaaagagaggtactatgcaaaccacaagaggtgcttttatggaagatgcattctattttgataataaatacttctctatttctcaaaatgaagctaaagaaatgtctcctgaacaacgttggttaatggaattagcagttgaaacctttgaagatgctaacatcaatccaaagaaattaaagggttcaagaactggtgtatttgtcggctcttctggtatggactttgtttcagcccaaatttctcatgctaatgatttaactcaacattccgctactggtctagaactctcaattcttgctaatcgtatttcttacttctttgatttgaatggtccatccatttgtactaatactgcttgctcagcttcaatgaccgccttaaatcttgctattaattcaatgattactgatgattgcgatgctgcactcgttgctggaactaatttattatttactccaggtagttatgttgcttattctcaacttcgtgttgtttccactgatggttcatgtaagccattcgataagaatgctgatggttattcacgtattgaaggtgctggtatgattttaattaagccatatgaaaaagctgttaaggatggtgataagatttactgtgctattttaggtagtggtactaatgaagatggtcatactccatcattaactatgccatcttacagttctcaatgcaagttattaacacatgtttgcgaaaaatttgatattgatccagcttcaattgattatgttgaagctcatggtacaggtactgcagttggtgatccaattgaagctcgttccattggttacgcctatggtcgtagagttcgtgaaggaaagcaaattaaaactactcgtccaggtgaaactgaagaaattttagatcaacctactttcccattacttattggttcaagtaagggtaatactggtcatggtgaatattcaagtggtattattgggatgattaaggctatcttaatgttataccaccgtactatggtgccaaccattgctcataaggaaatgaacccagcaattgatgctgaaggtttaggaattaaggtagctactaaattggaaccatggaccactccacatactttacgtattgctgttaattcttttggttttggtggttccaatggtaatgctattttcgaagaagttgttaatga

SEQ ID NO: 26213 - DNA, 1266 bp, Neocallimastix californiae
  PKS_KS
cgccattattggtatggcattacgtttaccaggtactatcaataattctaaatcattatggatgtcattagccaaaggaagagattgtgttttgccaccagttaaaactagagatttacatcatggttatgtcaacaaatcatttaatgagttaggtccagatgaacactatcttcctcgaattggatgttatgatactcgtagtaatgctgctaaaccttcagaattcgatgcctcgttctttaactgtactgctgaagaagctatctcattagatcctagacatcgttggatcttagaaacaagttgggaggcattagaaaatgcaggtattgctccaaattctttagaaaatactttaaccggtgtctatgtcggtattaataatgaacatgaacatgaagatctattaaaggaatgtggtatcgttccacctgttgcttcccataccttaaatcaaagtagtattgcgggacgtttaagctatttctataaactttttggtccatctttcactatcgatacggcctgctctactggttcttctgcacttcatactgcttgtagagctatgcaatatggtgaatgtgatctatctattgttactggtgtaaaatacatgtattcctccaaggaattccataaaacatgttctgcccatatgacttctccaaacggtcgttgtgctacgtttgatgaaagtgcagatggatttgctcagagtgaaggttgtgttacttttattttaaaacgtcttgatgatgctattcgtgataacgacaatattttaactgttattcttagttctgttagtggtcaaagtggtttcagacaatccattagtgctccttcctatgaaggacaagctattaatattgaaagggcaatgaaaattgctggaatcaagccagaacaagtttcttacgttgaagctcacggtacaggtaccccattaggtgatgctattgaaattcatgctcttaataaagtttatggtggtagtcatacggaagaaaatcctttaattgtcggaagtattaaatcaaacattggccatacctgtgaagctgctggtttagccggtattgcaaaggtcatcgtttccatgaaacataatcttattccaaagaatattcatttcaataaacttaacccagaaattgatatttcagctattccaatgaagataccaacaaaacatataccatggacttctcctaacgaggatgaaccacttattgctcaagtttcttcctttggtttaca

SEQ ID NO: 26214 - DNA, 1293 bp, Neocallimastix californiae
  PKS_KS
agctattattggtgttggttgtcgtttaccaggtgatattttaaccaaagatgatttttggaatatgttagtaacaaaacgtgttgtcacaactgaaattccagctgatcgttgggatcgtgatgaatggtatagtgatgagcctattccaggtactattcagacgaaacatggtggtttccttactaatgcttatgattttgataataaatatttttctatttctcaagctgaagctcttgaaattactccagaacaacgttggttatgtgaacttgctgttgaaactatggaagatgctaatattcgcccagaagaattaaaaggtagtcaaacaggtgtttttgttggttctgctggtattgattttggtggtaaccaattagttaatacattacaaatgtccgctcataccatgacaggtttagaaccatctatcttttctaatcgtatttcttacattttcgatttacatggtccttccattacaagtaatactgcatgctctgcttcaatgtcctctttatctatggcttgcaatgctattgctgttggtgattgtgataaggcttttgttgctggttccaatttcttaccatctccaggtggctatgttgctttctctcaacttagagtagtttctaagactggttcttgtaaaccatttgatgaaaaagcggatggttatgctagacttgaaggtgcttgtatgcttttaattaaagattatgaaaaggctgtaagagataatgataagatttatgcttgtattattggtagtggtactaatgaagatggtcgtacattatctataactatgccatcctcagatgctcaatgtactttaatgaagtgggtttgtgaaaaaagtaatatcaaggcagatactattgattatgttgaagctcatggtaccggtacaccaactggtgatccaattgaagccagatctattggtaatgcctttggtaaggctgttcgtgctccaggtagtaagccacttccagttggtactgttaaaggtaacgttggccatggtgaatttttaagtggtgcaattggtctcttgaaaacttcgttaatgcttttcaataaacaattagttccaacagcagcttttgaaaaattaaatccaaaaatagatgtcagtggtttaggtattcgtgttgcagataaaaatgaacctatggttaaacttaatggtaaagaaaataccccattgcgtgctgctgttaattcctttggttttggcggtgctaatgccaatgctattttagaatctgttgaaaaaat

SEQ ID NO: 26215 - DNA, 1302 bp, Neocallimastix californiae
  PKS_KS
ggcagtgattggtatggctcttcgtttacctggtgccatcaataattctaaatcgttctggatgtctttagccaaaggtagagattgtgtcttggctccagtcaaggatagaaaattacaccttggttatgtggataaaccatctaatcttttaggagaaaatgaacataatattccaaaatgtggttgctacgattctcgttcaaatgcagctaaaccttctgaatttgatgcagaattcttcaactgtttacctgaagaagtcaatagtatggatccaagacaacgttgggtcttagaaacgagttgggaagctttcgaaaatgcaggtattgctccaaataccttagaaaataccaccactggtgttttcgtgggtgtaaatgatgatcatgactatcaagatttattgaaagaaaacggtatcgctcaacctatttcagcacattctactccaagtggtattgctggccgtctcagttacttctataaacttttcggaccttcctttactatcgatactgcttgttctacaggtgcttctgccctccactctgcttgtcgttccttacaatttggagattgtgacttatcagtggtttccggagttaaatatttatattctgcctctgaattccatagaaccagtgttgctcgtatgacctctcctcatggtcgttgtgccacgtttgataaggatgctgatggttttgcaccaggtgaaggttgtgttacgtttattttgaagcgtcttgaagatgctgttcgtgatggagataatattctttcagttatccttggtaccagtagtggtcaaagtggtttaagacaatcgattagtgcaccatcttctgatggtcaagtacttaacttgaagagagcacttaaatttgcaggtgttgatccatctgaagtttcttttgttgaagctcatggtactggtactccacttggtgatgccattgaagttgacgcccttaatcaagtttatggaggtagtcacaccgaagaaaatccattagtgattggtagtgtgaaaacaaacattggacatactaatgaagccgctggtttagctggtatggctaaggtcattttagccatgcaacataaatatattccaaagaatttacatttcaatacgcttaatccagaaattgatattcattccattccaattcaaattgctaccaaaaccatgccatgggaaacacaagataacaaaccacgtattgctcaagtatcttcctttggtttacaaggtagtattgttcatatcattcttcaagaatatattccaga

SEQ ID NO: 26216 - DNA, 1278 bp, Neocallimastix californiae
  PKS_KS
tgctatcattggtacgggtattcgtttaccaggtgaaattaataataaggatgacttttggaaggtaatgaccgataaaaaggtgatcaccggtctcattccagaagatcgttgggatcgtgaagaatggtatagtaaggtcgaaaagccaggcaccatacaaacccttcatggaggtttcattgaaaatgctttcgatttcgataataaatattttggtatctctcaaaatgaagcgttggacgccactccagaacagagatggctatgtgaattaacggttgaaaccgttgaagatgccaatatggatatggatgattttaaaggaagtcatacgggggtctttgtgggtacctccggtatggattatggtagttatgtcttttctgttcctgaaaaaattactaaatatacgtacagtggtattgaaccttccatccatgctaatcgtgtctcgtatcttttcaatcttcatggtccatcgctttccactaataccgcttgttcctcttccatgaccgccttatccattgcttgtaattcgatggccgctggtgactgtgaaatggctttagttgccggtactaacttcttccaagccccagctaatggagtagcctattcgcaacttcgtgtcgtttcgaagaagggagcctgtcgtccatttgatattggtgctgatggttatgctcgtttagaaggtgccgccatggtcttgttgaagccatatgaaaaggccattaaggataataatcgtatttatgccactattttaagtaccgcttgtaatgaagatggtaagacctcatccttgacaaccccatcctccgaagcgcaatgtcaactgatgaaacgtgtgtacagtaagggccacattgatccttgtaccattgattttgtggaagcccatggtaccggtacctctgttggtgatcccattgaagctcgatccatcggtgaagcctatggtaaggtgaataaggccaatggacatcctttactacccgtaggctcagtgaaaggtaatgtgggtcatggtgaatatttgagtggtatcgttggattaattaagggtgccctcatcctccacaagaataccattgttccacagaccgcgtttgagacgttgaatccaaagattcattgtgatgaactgggtatccgtattgctgataaggtggaacctcttccaggtaaaggacgtcatagagccgccgtcaactcatttggttttggtggtgctaatgccaacgtaattttagaggaggagcctcaagt

SEQ ID NO: 26217 - DNA, 1305 bp, Neocallimastix californiae
  PKS_KS
cgccatcattggtatgggtttacgtcttccaggtgctattaataatgaaaagaccctctggtctgctttagttaaaggtagagattgtgtttccaatattccaaaggatcgtaaactccatgaatcctacgtaaataaaccatctaatgaacttaacccaggagaacataatgttaagaaatgtggttactacgactctcgtacctctggtgaaaaagtttctcaatttgatgctgaattctttaactgtcttccagaagaagccattggtcttgatccaaagcatcgttggattttagaaactagttgggaagccttagaaaatgctggtatctctccagattctcttgaagattccaacactggtgtctttgtcggtatcggtgatcagcaagaccatgcccaattcatgaaggaatgccataggaaaaaggttgtcagttaccacaacagtaatccatctgctattgctggtcgtctcagctacttctacaagctctatggtccttcagtgacagtggatactgcttgttccactggtgccaccgcccttcatacggcctgtcgctccatgatctatggtgattgtcgtctcgccatggtcactgcctctaagtatctcttttacccagaagaatttgaaatgaccagtaaggctagaatgacctctcctaatggtcgttgtgctaccttcgataaggacgctgatggttacgcgcccgctgaaggttgtgttaccttcatcttaaagtgcttagaagatgctgaacgtgataaggatcatattcttggtgttatcttaggaactagtagcggtcaaagtggcttccgtcaatccattagtgttccttcttttgaaggtcaagctagaaacattaagcgtgttatggaaattgctggggttaatccttccgatatctcctacgttgaaactcacggtaccggtaccccatacggtgatgccattgaaattcaaggtataaaccaggtctatgctggttcccatactcctgaacatccattagtcattggtagtatcaagaccaatattggtcataccgctgaaacctctggtttagccggaattgcaaaggttttagtggccatgaagaataagaccattccaagacaccttcacttcaagaccctcaatccagaaattgatttgaaatctgttccattagccattccaacccataatatgaaatgggaaactgaggaaggtaagccaagaactgctctcgtttcttcctatggtttacaaggtagtgccgtcaatattattcttcaggaatacattccacc

SEQ ID NO: 26218 - DNA, 1308 bp, Neocallimastix californiae
  PKS_KS
tgctattattggtatgggtcttcgtttacctggtgctattaacagtgcaaaatctctttggttagctttagctaagggtaaggattgtgttttacctccaattaaaactagagatttacatcgtaattacgttaataagccaagtgatcaattagatccaactgaacacaatattcctcgtttaggtttatacgatactagaaatagtgttgctaagccatctcaatttgatgctaagttcttcaattgtttaccagatgaagccttagctcttgatccaagacatcgttggattttagaaactagttgggaagccttagaaaatgctggtattccaccaaactctttagaaaattcttctactggtgtatttgttggtattaacgatgatcacgaatattctgatttattaactgaatgtggcgttaagagtccaattgctgctcatggtcaaagtccaagtggtattgctggtcgtttaagttacttctatagattatatggtccatccttcactatggatactgcttgttcaactggtgcttctgctcttcatactgcatgtcgttcattacaatgcggtgattgtgatttatctattgtttctggtgttaaattcatgtattcttccaaggatttctacatgacttgttctgctagaatgacttcaccacatggacgttgtgccacatttgataaggatgctgatggtttcgtaccaggtgaaggttgtgttaccttcatcttgaagcgtttagaagatgctgttcgtgacaatgatcacatcttatctgttgttttaagtactagtagtggtcaaagtggtttaagacaatctattagtgctccatcctcagaaggtcaagctattaatatgcgtaaggctatgaagtttgctggtattaaaccagaagatgtgtcatatgttgaagctcatggtactggtacaccattgggtgatgctcttgaagttcatgccttaaacgaaatttacggtggtagtcatactgaagaaaatccacttgttgttggtagtatcaagactaatattggtcacacttgtgaaactgctggtttagctggtattgctaaggtcattgtttcaatgcaacacaaacatattccaagaaaccttcacttcaataccttaaatccagaaattgatattaaatctattccaattcaaattccaaccaagaccttaccatggaactctactgaaccaaacaagccacttatcgctcaagtttcttcctatggtcttcaaggtagtattgttcatgtcttcttacaagaatatattccaga

SEQ ID NO: 26219 - DNA, 1314 bp, Neocallimastix californiae
  PKS_KS
tgctgtggttggtattgctttaagacttccaggtggtatcaacaccgttgataagtattggaaaagtttagaaagtggtagattctgtatctctccaactggtactaatcgtcttcttcatcacaacctgactcacaatgaacacttaaatcctggagaacattatattttcaactactgtcgttacgatagtacttctgacgtttcccctatcactgatttcgatccattgttctttaacatgaatccaagtgaggctaccgttctcgatccaaaattccgttgggtcttagaaactacttatgaagctttccaagatgccggtataaacccggataccctttctggtactcgtactaatgtatataccgctccaggtcaagttgatgaaatgaatacctacactattgatgcctccccaaccggttacagtattcttaacggtatgagtatgcacagttgtgctgctgcttctttaccaggtagaattagtttcatgtataacttgtacggtgctgcccacactgtagataccgcttgttcttccggtttagtagctactcatgatgctttcaaggatttaaacatcggtgaaactgatcttgctatcgttaatgctgctcactgtccatttcaaagtagtggtttcagtcttttgtctgttgctaagatggtttcaagaaattgtagatgtgctgcttacgatgaagccgctgatggatatgttcctggtgaaggttgtgtctccattatcttaaagagaaaagatgatgccatccgtgatcacaacaaaatttatggtttaattaatgctacagctgtcggtcaaagtggttcaagagcttctatgagtacaccatctgctattggtcaaaagatcattcatgaagaagtcttaaagaatgccaaccttactccaaaagatattgactatatggaaggtcatggtactggtacaaaattaggagatcgtattgaaggagaagccatcaatgaagttttcaagggatctcactctgaaagtcgtccattaacattagctagcgttaagactaacattggtcacactgaagaagttagtggtttagcctctcttgttaaggtcttattagccatgaaatacaagaccattccacctcaccttcacttccataaaccaagttcctccattgatttcgattctgttccattacacattccaactcaaaaggaagaatggaaagcccatgacggtaagaatcgtattgccctcgtttcttcctacggtctttccggtagtgtctgtgatgctgttgttgaagaatacgttgaccc

SEQ ID NO: 26220 - DNA, 1347 bp, Neocallimastix californiae
  PKS_KS
tgctattgttggtataggattacgtcttccaggaggtattaattcaaccaaaaagttctggttttcattaattaaaggtaagaattgcttatcagctacaccaacggatcgcgaacttcatttaggaatggtagatatgagtaagaagccaccggaatatcgactaaataaaaatgaacattatgtttgtagatatggtatttatgattctcattatgcctcatctggagtaaagtacactgattttgatgctaatttctttgactgctctaccgaggaagctattagcatggatgtcaagcagcgttggatgcttgaaacaagttgggaagctttagaagatgccggtatagatccttcctccatcgaaaattctgataccggagtattcataggaatgaacaattgctatcatcaaacaaagcttttgtcctccaagaaagccactaacattagctcttctttcaatccaaccacccttcattgtacagatctttcatcagtagctggacgaatttcctatttctataagatatacggaccagccatttctatggatactgcatgctcaacaggagctaccgcactacatacagcgtatcgttctatgcaatatggtgaatgtgatttagctattgtatccggggctcgatttctttactacaatgacgaatttattaatacttctcatgctaaaatggcatcaccaaatggacgttgtgccacttttgatgaagatgcggatggatttgcacctgcagaaggttgtgtgaccctcatcttaaaaagactagatagagctgaagaaaataatgataatatttatggtatacttctaggtagtagtaatggacaaagtggaggacgtcaatccatttctgttccatcttctgaagctcaagttcgtaatattaaaaatgcattaaaagatgctcatgtatctccaaaagatatatcgttcgttgaagcccatggtaccggtaccccttatggtgatgcaatagaaattcatgccttaaatcaaattttcaaagattcacattccaaaaaatcacccttatatattggaagtgtcaaaactaacataggacatacctgtgaagcagctggattagccggtattgttaaagtcttactctccatgaagcataatgtcattccaaaacatattaactttaaaaagttaaatcctgaaattgatttaagtatggttccattttgtattcctagtcaaaagaatattcgttggacatctccagatccttctaaaccgttaattgccgaggtctcttcctatgggttacagggaagtatcaccaacgttatacttcaacaatatcttcctcc

SEQ ID NO: 26221 - DNA, 1347 bp, Neocallimastix californiae; identical to SEQ ID NO: 26220
  PKS_KS

SEQ ID NO: 26222 - DNA, 1347 bp, Neocallimastix californiae
  PKS_KS
tgctatagttggtataggattacgtcttccaggtggcatcaattcaaccaaaaaattctggcattcattattacaagggaaaaattgtttatccactacacctgttgatcgtcaacttcacctgggaatgatagatatggctaaacaacaacctggatataaattaaataaaaatgaacactatattcacaaatatggttattatgattcaattcatacggcttctatagcaaagcctacaaagtttgatgctaatttctttgaatgtactaatgaagaagctattggaatggatgttaagcaacgatggatgctggagactagttgggaagctttagaagatgctggtattgatccttcaactcttgaaaattcaaatacaggtgtatttattggaatgaataactccaatcatcatataaaacttttatcttcagagaaagccactaatgtaggacctaacttcagttcagtcacacttcatggtactgatctttcttcagctgcaggtcgtatttcttatttctataagttatatggcccagcaatttccatagatacagcatgttcaacaggagctacagcattgcatactgcctatcgatctatgcaatatggtgattgtgatctagcaatagtttcaggtgctcgattcctttactataacgatgaatttattaatatttctcatgctaagatgacttcacctaaaggacgttgtgcaactttcgatgaaagtgctgatgggtttgcacctgccgagggttgtgtaacattaattttaaaaagacttgatgatgctgaagaaagtaatgatgacatttatggtattctccttggtagtagtaatggtcaaagtggaggacgtcaatcaatttctgttccttcctcagaagctcaagtacgtaatattagaaatgcactaatggatgctcaaatctctccaaaggacatttcatacattgaagcccatggtactggaactccatatggtgatgcgttggaaattcacgctttaaatcaagtttttggagaaagccatactaaaaattcaccattgtatattggtagtgtgaaaactaatataggacatacctgtgaagcagcagggttagcaggaattgttaaagttttactatccatgaaacatcaaataattccaaagcatattaattttaaaaagttaaatcctgaaatcgatttagaaactattccactttgtattcctagtcaaaaaaatattcattggacgtcttcagatccttctaagcctttaattgcacaaatctcctcttatggtttacaaggaagtgttacaaatattattcttcaacaatatcttccacc

SEQ ID NO: 26223 - DNA, 703 bp, Neocallimastix californiae
  PKS_KS
ggaagctttagaaaatgctggtattgctccaaattctctagaaaatactttaactggtgtctatgtcggtattaataatgaacatgagcatgaagatttattaaaaaaatgtggtatcgttccaccccttggttcccataccttaaatcaaagcagtattgctggtcgtttaagttatttttataaactttttggtccatccttcaccattgataccgcttgttccacaggttcttctgctcttcatattgcttgtaatgctatgaaacgtggagaatgtgatttatctattgttacgggtgtgaaatatatgtactcctccaaagaatttcataaaacctgttctgcccatatgacttctccaaagggtcgttgtgccacttttgacgccagtgctgatggttttgctcaaagtgaaggttgtgttacttttgttttgaaacgtttggatgacgctattcgcgataaagataatattttaacagttattcttggttcagttagtggtcaaagtggtttaagacaatcaattagcgctccttcctacgaaggtcaagctctcaacatcgaaagagcaatgaaaattgcaggtatcagtccagatcaagtatcctatgttgaagctcatggtactggtactcccttaggagatgctattgaaattcatgccctgaatgaagtctatgctggtagtcactccaaa

SEQ ID NO: 26224 - DNA, 1302 bp, Anaeromyces robustus
  PKS_KS
tgctattattggtatggctttacgtttaccaggagctattaataatgctaaatctttctggatggctttagctaaaggtaaagattgtatttctacaccagttaaagatagaaaattacatcttggttatgtgaataagccatcccatcttttaaatgaaaatgaacataatattcctcgttgtggttgttatgattcacgttcaaatgttgctaaaccttctgaatttgatgcagaattctttaattgtcttccagaagaagctatggctcttgatccaagacatcgttggatattagaaacaagttgggaagctttagaaaattcaggtattgcaccaaattcattagaaaataccattactggtgttttccttggtataaatgatagtcatgattatcatgatttaatgaaagaaaatggtattacaccacctattgctgcccattctacaccaagtggtattgttggacgtcttagttatttctataaattatttggaccttctttcacgattgataccgcttgttctactggtgcttctgctttacattctgcctgtcgttcattacaatttggagattgtgatttatctattgtttccggtgttaaatatttatatacttcaaatgatttccatagaacaagtattgcacgtatgacttcaccaaagggaagatgtgctacttttgataaagatgctgatggatttgttccaagtgaaggatgtgttacttttattcttaaacgttatgaagatgctattcgtgatcatgataatattctttctgttatattaggtactagtagtggacaaagtggtattagacaatctattagtgccccatcttcagatggacaagttattaatttaaaaagagctcttcattttgctggtgtcgatccatccgatatttcatttgttgaaactcatggtacaggtacaccacttggggatgctattgaagttaatgctttaaatcaagtttataaaggaactcatacttctgagaatccattaattattggtagtgttaaaactaatattggtcatacaacagaagttgcaggtttagcaggtgttgctaaagttattttatctatgcaacataaatatattccaaagaatttacatttcaatacattaaatccagaaattgatattgaatctattccaattcaaattgctactaaaactataccatgggaaaataaaaataataaaccacgtattgctcaagtttcatcctttggtttacaaggaagtattgttcatattattcttcaagaataccttccaga

SEQ ID NO: 26225 - DNA, 1302 bp, Anaeromyces robustus
  PKS_KS
tgctattattggtatggctttacgtttaccaggtgctattaataatgctaaatctttctggatggctttagctaaaggtaaagattgtgttactacaccagttaaagatagaaaattacatcttggttatgtggataagccttcacatcttttaggtgaaaatgaacataatattcctcgttgtggttgttatgatacacgttcaaatgttgctaaaccttctgaatttgatgctgaattctttaattgtcttccagaagaagctatggctcttgatccaagacatcgttggatattagaaacaagttgggaagctttagaaaattcaggtattgcaccaaattcattagaaaatacaattactggtgttttccttggtataaatgatagtcatgattatcatgatttaatgaaagaaaatggtattacaccacctattgctgcacattctacaccaagtggtattgttggacgtcttagttatttctataaattatttggaccttctttcactattgataccgcttgttccactggtgcttctgctttacattctgcttgtcgttcattacaatttggagattgtgatttatctattgtttcaggtgttaaatatttatatacttcaaatgacttccatagaacaagtattgcacgtatgacttcaccaaagggaagatgtgctacttttgataaagatgctgatggatttgctccaggtgaaggatgtgttacttttattcttaaacgttatgaagatgctattcgtgatcatgataatattctttctgttatattaggtactagtagtggacaaagtggtattagacaatctattagtgccccatcttcagatggacaagttattaatttaaaaagagctcttcattttgctggtgtcaatccatccgatatttcatttgttgaaactcatggtacaggtacaccacttggtgatgctattgaagttaatgctttaaatcaagtttataaaggaactcatacttctgaaaatccattagttattggtagtgttaaaactaatattggtcatacaacagaagttgctggtttagcaggtgttgctaaagttattttatctatgcaacataaatatattccaaagaatttacatttcaatacattaaatccagaaattgatattgaatctattccaattcaaattgctactaaaactataccatgggaaaataaaaataataaaccacgtattgctcaagtttcatcctttggtttacaaggaagtattgttcatattattcttcaagaatacattccaga

SEQ ID NO: 26226 - DNA, 1284 bp, Anaeromyces robustus
  PKS_KS
tgctattattggtataggttgtcatttccctgaaggtatagaatcaaaagaagatttttggcaaatgcttgaagatgctcgttgtattaccaaagatataccaaaagaaagatgggataaagatgaatggtattctgaggaacctattcaaggtactattcaaacaaaacgtggtgcctttttaaagaatccttatctttttgataataaatatttctatatttctatgccagaagctaaagaaatgtcaccagaacaacgttggcttttagaattaactgtggaaactttagaagatgctaatataaaaccagaaactttgaaaggtactcgtactggtgtttttattggttcttctggttgtgattatttagctacacagatttctcatgctaatgatattaattctcattctcctactggatttgaactttcaattttagctaatcgtttatcctatgtatttgatttacaaggtccatcgattagttgtaatacagcatgttcttctgcgttttcagcattaaatattggtttaaatgctatgattactgatgattgtgaaatggcgcttgtagctggttctaatttcatgaattgccctggtggatttgttgctttttctcaacttcgtgtagtatcacctgatggttcttgtaaaccatttgatgaaaaagccaatggttatgctagattagaaggtgcaggtatggtattaattaaaccttatgaaaaggcagttcgtgatggggataaaatttattgtgctattgttggatgtggaagtaatgaagatggtcgttcaccttcccttactatgccatcttatgaagctcaatataaacttttaactcatgtttgtgaaaaatcgggtattcatccaactcaaattgattatgtagaagctcatggtacaggtacaaaagtaggtgaccccattgaatcacgggctattggtgatgcttatggtaaaagtaaaggtattcgtggtccaaatgatccaccaattttaattagttctgttaaaggtaatacaggacatggtgaaaattctagtggtatagtaagtattattaaaacttctatgatgcttcataaacgtcgtctcgtacccactgtagcttatcatcatatgaatccagccattaatgcagaaaaattaggtattaaagtatgtgaaactttagaagattggaaaacaccacatttattacatgctgctgttaattcctttggatttggtggtgctaatactaatactatattagaggaagtacctcattt

SEQ ID NO: 26227 - DNA, 1308 bp, Anaeromyces robustus
  PKS_KS
tgctattattggtatgtctttacgtttaccaggttcaattaatagtgctaaatccttctggatggctttagctaaaggtaagaattgtgttttaccacctgttaaaaatagagatttacatcatggttatgttaataaaccaagtgatcaattaaatccaggggaacataatattccatatattggttgttacgatactagatctaatgttgcaaaaccatcccaatttgatgctgaattctttaattgtttaccagatgaagcattagcacttgatccaagacatcgttgggtattagaaactagttgggaagcattagaaaatgcaggtattccaccaaattcattagaagattcacttacaggagtatttgttggtatgagtcaagatcatgaatatgctgatttattagctgaacgtaatattatagctcctattgctgctcattctaatactcaaagtggtattgcaggacgtttaagttatttctatcgtttatatggtccatcattaactatggatactgcctgttctactggtggatcagctattcatactgccgttcgttccttacaaaatagagattgtaatttatccattgtttcatgtgtaagatacatgtatacctccaagactttctataaaacatgtgctgcaagaatgacatctcctcatggacgttgtgcaacatttgataaagatgctgatggatttgcttctggtgaaggatgtgtttgtttcgttttaaaacgtttagatgatgctattcgtgataatgatcatattttaagtgttattataggtactagtagtggtcaaagtggtttaagacaatccattagtgctccatcctccgaaggacaagctataaatattaaaagagctatggaaattgcagatattaaaccagaagatgtttcctatgttgaagcccatggtacaggtacaccattaggtgatgcattagaaattcattccttaaatcaagtttatgctggtagtcataatgaagaaaatccattagttgttggtagtgttaaaactaatattggacacacaggtgaagttgccggtttagctagtattgctaaagttattttagctatgcaacataaacatattcctaagaatcttcatttcaatactttaaatccagaaattgatattgaatctattccaattaagattccaactaaaactataccatggacatcaccagttcctaataaaccattaattgctcaagtttcatcatttggtcttcaaggtagtattgttcatcttttccttgaagaatatattccaaa

SEQ ID NO: 26228 - DNA, 1317 bp, Anaeromyces robustus
  PKS_KS
tgcagttattggtatgggtattcgtttaccaggtggtattaatacccctggaaaatattggtctgctttagttagtggtagagattgtacatcaccaacaccaactaatcgtcaccttcaccactatttaaaaccaggatgtccagccaatgaattaggaccaatggaacattatatccatcgtggtggtttctatgataccactccagatgctgctccacttagtgattttgatccaacttttttcaacatttcaccattagaagctaaagctacagatccaaaatttcgttgggtttatgaaactgtttatgaagcttttcaagatgcatgtattaatatatctgaattaaatggatctcgtactagtgtttattgtactgtaggtcaaattttggattatgtttctgtagctagagctttcaacaaaagtgaaaatatgacaagtcaaactatgcatggaagtaatccttctagttgtgctggtcgtattgcttttaattatggtttcaccggtccatctgatactattgataccgcttgttcaagtggtttaaatgatgttaacaatgcttgtaaggccctttcttgtggtgatactgatttagctgttgtttcagctgttcatcaacaaattattggtactcaatttcatgttatttctgttgctcaaatggcttctcatcttggtcgttgtgctactttcgatgctgaagctgatggttatgctccaggtgaaggatgtattagtcttattcttaagcgtttagacgaagctgttactgatcatgaccgtatttatggtgttattactggtatttctacagctcaatcaggtactagacgttctatttctactccagctgttggcccacaagcagaaaatatgagaagagttttatctatggctaatattaatgcatctgatgttgattatcttgaagctcatggtactggtactccagtaggtgatgctattgaaactgaaactttaaatcttgttttcggtaaaactcataccgaaaagaaacctttaattgttggtagtgttaagactaacttaggtcacacagaagaagtttctggtttagctggtttatgtaaagttcttttatctatgtcacatcgtataattccaccacatcttcacttaaagaacttaaatccacgtattgatctttctgttattccaatgactattccacaaaagaaatgcatttggaagagtccacgtggtaaaaagagaattggtgttgtttcctcttttggtttacaaggtagtattgctaatgctgttgttgaagaatttaaacttcc

SEQ ID NO: 26229 - DNA, 1314 bp, Anaeromyces robustus
  PKS_KS
tgcagttgttggtattgctttaagacttccaggtggtataaatacagttgataaatattgggatgttttagttaatggaaaattctgtgctactccaactggtactaaccgtcatcttcatcattatatgactacagctgaacatttaaaaccaggagaacattatgttactaaatattgtcgttatgatagtactccagatgcagctccaataactgattttgatccaatgttctttaatatgaatccaagtgaagctgctgctcttgatccaaaattccgttgggttttagaaactacatatgaagctttacaagatgcttgcattaatccagattctctttctggtactcgtactaatatttatactgcaccaggtcaagttcatgaaatgaataattatactactagtgcttcaccaactggttttagtgtacttaatggtcaaagtatgcatggtgttgcttgtgcttctttaccaggtagaattagttttatgtataacttatatggtgctgcccatacagttgatactgcttgttcttctggtttagttgctgctcatgatgcttttaaagatttaaatattggtgaaactgatcttgctattgttaatgccgctcattgtccatttataggtagtggtttcagtcttttatctattgctcaaatggtttctagaaattgtagatgtgctgcttatgatgaagctgctgatggttatgttccaggtgaaggttgtgttaccgtcattttaaagagaaaagatgatgctattcgtgatcataataagatttatggtttaattaatgctgctgctgttggtcaaagtggttccagatcttctatgagtactccaactgttgaaggtcaatctagaattcataaggaagttttaaaattagctcatcttgaaccaaaagatattgattatatggaaggtcatggtacaggtacaagtttaggtgaccgtattgaaggtgaagctattaaccttattttcaaaggtactcactctgaaactcgtccattaactttagctagtgttaaaaccaatattggtcatactgaagaagttagtggtttagcttctcttgttaaagttttattagctatgaaaaataagactgttccaccacatcttcatttccataatccaaatccttcaattgatttcaaatctgttccattacatattccaactcaagttgaagaatggaaaccagttgaaggtaagaagcgtgttgctttagtttcttcttatggtctttctggaagtgtttgtgatgctgtcgttgaagaatatgttgatga

SEQ ID NO: 26230 - DNA, 1293 bp, Anaeromyces robustus
  PKS_KS
tgctattattggtgttggttgtcgtttaccaggtgatattactaccaaagaagacttttggaatatgttagttactaaacgtgttgttacatcagagattccagctgatcgttgggatcgtgaagaatggtatagtaaggaaccaatcccaggtactattcaaactaaacatggtggtttcctttctaatgcttatgactttgataataaatatttttctatttctcaagctgaagcacttgaaattactccagaacaacgttggttatgtgaacttgctgttgaaaccatggaagatgctaatatacgtccagaagaattaaagggtagtcaaacaggtgtatttgttggttcagcaggtattgattttggtggtaaccaattagtaaatacattacaaatgtctgcacacactatgactggtttagaaccatcaattttttctaatcgtatttcttacatttttgatttacatggtccatccattactagtaatacggcttgttcagcttctatgtcttcattatctatggcttgtaatgctatagcagttggtgattgtgataaggcttttgttgctggttctaatttcttacctactcctggtggttatgttgctttctcacaacttagagttgtttcaaagactggttcatgtaaaccatttgatgaaaaagctgatggttatgctagacttgaaggtgcttgtatgttattgattaaagattatgaaaaggcgattagagataatgataagatttatgctacaattattggtagtggtaccaatgaagatggtcgtacattatctattacccttccttcctctgatgctcaatgtgctttaatgaaatgggtatgtgaaaagagtaatattaaggctgatactattgattatgttgaagctcatggtactggaactccaactggtgatccaattgaagccagatctattggtaatgcttttggtaaggttgttcgtactccaggaagtaaacctcttccagtaggtacagttaaaggtaatgttggtcatggtgaatttttaagtggtgctattggtttattaaagacttctttaatgcttttcaataagcagttagttccaactgctgcttatgaaaaattaaatccaaaaattgatgttaatggattaggtattcgtgttgctgataaaaatgagccaatgataaaaattaatggtaaggttaatactccattacgtgctgcagttaactcttttggttttggtggtgctaatgctaatgctattttagaagctgttgaatccat

SEQ ID NO: 26231 - DNA, 1308 bp, Anaeromyces robustus
  PKS_KS
tgctattattggtatggctcttcgtttaccaggtgcaattaataatgctaaatctttatggatgactttacttaaaggtaaaaattgtgttgtagccccagttaaaaatagagatttacatactaattatgttaataaaccaagtaatcaattacttccaaatgaacataatattccatattttggttgttatgatactaaatctaatgttgctaaaccttcacaatttgatgctgaattctttaattgtttaccagatgaagctttatcacttgatccaagacatcgttggattttagaaacaacttgggaagctttagaaaatgctggtataccaattaattctttaaaaaatacaactactggtgtttttgttggtattaatgatgatcatgaatattcagatttattagaagaaaatggtatttctattcctatttcttctcattctaatcatccaagtgatattgctggtcgtttaagttatttttataatttatatggtccatcttatactatggatacggcttgttctacaggtgcttcagctattcatgtagcttgtcgttccttacaaaatagagattgtaatttatgtatggttactggtgttaaatatatgtattcttcaaaatctttaagtaaagcttgttcagctagaatgatttcccctcatggtcgttgtgctacttttgatatagatgccgatggatttgtaccaggtgaaggttgtgttacatatattttaaaacgtttaaatgatgctattgaagataatgataatattttatctgttattattggtagtagtagtggtcaaagtggattaagacaatccattagtgcaccatcatcagaaggtcaagctcttaatattcgtaaagctatggaatttgctcaagttaaaccagaagatatttcttatgttgaagctcatggtacaggtaccccattaggagatgctatggaaattcatgctttaaatgaagtttatgctggtactcattcaaaagaaaatccattaattgttggtagtattaaaactaatattggtcatacttgtgaagttgctggattagcaggattagctaaagttattgtttcattacaacataaacatataccaagaaatcttcatttcaataaacctaatccagattttgatcttaattctattcctattaaaattccaacaaaaactcttccatggaattcattaaaacctggaaaaccacttatagcacaagtttcttcctttggtcttcaaggtagtattattcatcttattattgaagaatatattcctaa

SEQ ID NO: 26232 - DNA, 1338 bp, Anaeromyces robustus
  PKS_KS
agctattgtaggtattggattacgtctaccaggtggtattaattcaactcaaaaattttggctttctcttattaaaggaagaaattgtttatcaaatactccaactgatcgtcaattacatcaaggttttgttgatatgcaaaaaaatccaaataaaaatttagatattaatgaacattatattggtaaatatggctattatgaatctgttcgtggtaccgcaaaacccacagattttgatgcagatttttttgaatgttctaaagatgaagctattggtatggatgttaaacaacgttggatacttgaaacaagttgggaagctttagaagatgcaggtattgatccatctattattgaaaattctaatactggtatatttgtaggtatgaataattgtaatcatcacgtaaaattaatggcctctaaggaagctaccaatattaattcaaattataatagtattactactcatggaacagaattatgttctgtagcaggtcgtctttcctatttttataaattatatggacctgctatatcgattgatacagcatgttctacaggagcaacagcagtacatgttgcttgtcgttcaattcaaatgggagaatgtgatttagctattgtttcaggagctcgatatctttattataatgatgaatttattaatacatcacatgcaaaaatgacatcaccaaataatcgttgtgctacatttgatgaatcagcggatggatttgcatcttctgaaggatgtgttaccttaattcttaaaagattagatgaagcagaagaaaataatgataatatctatggagttattcttggatcaagtaatggacaaagtggaggaagacaatcaatttcagtaccatcatcagaagcacaagaacgtaatattcgaaatgcaatgaaaaatgcaaatgtatctcctaaagatatttcatatattgaagctcatggtactggtactccctatggagatgcattagaaattcatgctattaatcaaatatttggacatactcatactcaagattctcctctttatatcggtagtgtaaaaacaaatataggacatacatgtgaagcatcaggattagcaggacttgtaaaagttttattatccatgaaacatcaattaataccaaaacatataaatttccgtaaaattaatccagaaattaatttagatcttgtaccattaaatataccttatcaaaaatgtattccatggaaatcttcggatccaacaaaacctttaattgcagaagtttctagttatggattacaaggtagtgtaacaaacattatcttacaacaatatataccacc

SEQ ID NO: 26233 - DNA, 1314 bp, Piromyces finnis
  PKS_KS
tgctgttgttggtattgcgttaagacttccaggaggtataaatactgttgacaaatactggaatagcttagttgatggtagattctgtatctcaccaattggtacaaatcgtcaccttcaccactacatgtctaaagaagaaaacttaaagccaggagaacattatatttacaactatggtcgttatgattctaccccagatgctgccccaatttctgactttgatccaatgttcttcaacatgaacccaaatgaagcctctgctcttgatccaaagttccgttgggttttagaaactacttatgaagccttccaagatgcaggtattgatccagatgtcctttctggaactaatactagtgtatacactgctccaggtcaagtcgatgaaatgaatagatatgctattcttgcttctgatactggcttcagtgttcttaatggtatgagtatgcatagttgtgctgctgcttctttacctggtagaatcagtttcatgtataatttacttggtgctgcccacaccgttgatactgcttgttcttccggtttagttgctactcatgatgccgtcaaggacttaaaccttggtgaaactgatcttgctattgttaatgccgctcactgtccattcatgagctccggtttcagtcttttatctgtcgcaaagatggtctcaagaaactgtagatgtgctgcttatgatgaagctgctgatggttatgttcctggtgaaggttgtgtcactatcattttaaagagaaaagatgatgctattcgtgatcacaacaaaatttatggtttaattaatgctgctgctgttggtcaaagtggttctagagcttctatgagttctccaactgttattggtcaaaccaatattcataaacaagttttaaaaaaggctggtgttaatccaagtgacattgactatatggaaggtcacggtacaggtacaaaattaggtgatcgtattgaagcagaagctatcaacaatgtctttaagggtagtcactctaaggaacgtccattagttttagctagtgttaaaactaacattggtcatactgaagaagttagtggtttagcttctcttgttaaagtattattagctatgaaaaacaagactgttgcccctcatcttcatttcaaaaatccaagtcctttaattgatttcgattctgttccattacacattccaactcaaaaggaagaatggaaaccagctgaaggaaagaaacgtactgctttaatttcttcatacggtctttctggtagtgtcagcgatgttattgtggaagaatacattgaacc

SEQ ID NO: 26234 - DNA, 1266 bp, Piromyces finnis
  PKS_KS
tgcaattattggtatggcacttcgtttacctggtgctatcaataactcaaaatctttatggatggctttagcaaagggtaaagattgtgtattacctccagttaaaactagagatttacacactcgctatgctaataaatcagctgatcaattagaattagatgaacattatcttccacgtattggttgttatgatactcgtaatagtgttgcaaaaccatctgaatttgatgcttcatttttcaattgtttaccagatgaagcagttgccttagatccaagacatcgttggattttagaaactagttgggaagctttagaaaatgctggaattgcaccaaattcattaaaaaagactacaacaggtgttttcattggtattaacaatgagcatgagcatgaagatttattacatgattgtggtattatccccccattagcttcacatgctactgcacaaagtagtattgctggtcgtttaagttacttttatcaattatttggaccttcatatactattgatactgcatgttctaccggtagttctgcactccattctgcctgccagtcattacaatgtaatgattgtaatttatcaattgtaactggtgtaaaatatatgtattcttctaaggaattccataaaacatgctcagctcgtatgacatcaccaaatggtcgttgtgctacctttgatgctagcgctgatggatttgcccaaagtgaaggttgtgtcacatttatattaaagcgttttgatgatgctgttcgtgataatgataatatcttagctgttgttcttggttccgctagtggtcaaagtggtttaagacaatctattagtgctccttcttctgaaggtcagactgttagcattaagagagctatggaaaaagccggtattacaccagaacaagttagtttcgttgaagctcacggtactggtacaccattaggtgatgcacttgaagtccatgctcttaatcaagtttatggtggcagtcacactgaagaaaatccattaattgttggtagtattaagtccaatattggacacacatgtgaagctgctggtctagccagtattgctaaggttatcgttgctatgaagtataatcttattccaagaaatattcactttaatgaacttaatccagaaattgatctttcaactattccaatgaaaattccaaccaaaacattaccatggaatccaccaaatgatgatacaccacttattgctcaagtatcttcctttggtttaca

SEQ ID NO: 26235 - DNA, 1014 bp, Piromyces finnis
  PKS_KS
cttagaaacaagttgggaagccttagaaaacgcaaatattgctcctaattctttagaaaactcatctactggtgttttcgtcggaattaacgatgatcatgaatactcggatttaatgactgaatgtggtattgaaacatcaatcgctagtcatggttcaagtccaagtggtatcgctggtcgtttaagttatttctatcgtttatacggcccttctttcacaattgatactgcttgctcaacaggtgctaccgcacttcacactgcttgccgttcattacaacatcatgattgtaacttatctatcgtttctggtgtcaaatatatgtattcttcaaagaacttttataaaacatgtgctgccagaatgacttcaccacatggtcgttgtgctactttcgacaaagatgctgacggtttcgttcctagcgaaggttgcgtcacttttattttaaagcgtttagacgatgctatccgtgataacgataacattctttctgtcattttaagtacgagcagtggtcaaagtggcctaagacaatctattagcgctccttcctccgaaggtcaggctatcaacatgcgtaaagctatggaatttgctggtattaaacccgaagacgtttcttatattgaggctcatggtactggtactccattaggtgatgctttagaagtacatgctttgaacgaaatttatgctggaagtcatacagaagaaaatcctctcgttgttggtagtattaaaacaaatattggtcatacttgcgaaactgctggtttagctggcatcgctaaagtcattgtttctatgcaacacaaatatattccaaagaatcttcactttaatactttaaatccagaaatagatgttaaattaattccaatgaaaatcccaactaaaaatctaccttggaattcttctgatccaaataaaccacttatcgctcaagtctcttcttatggtcttcaaggtagtatcattcatgttttcttagaagaatacattccaaa

SEQ ID NO: 26236 - DNA, 1249 bp, Piromyces finnis
  PKS_KS
cgctattattggtgttggctgtcgtttaccaggtgatatatcaacaaaagaagacttttggaacatgttagttaccaaacgtgttgttacttcagaaattccatcagatcgttgggaccgtgaggaatggttcagtgaagatcctgttccaggtaccatacaaactaagtgtggtggtttcattaccaatgcttatgattttgataacaaatatttctctatttctcaagctgaagcttttgaaattactccagaacaacgttggttatgtgaacttgccgttgaaactatggaagatgctaatattcgcccagaagaattaaaaggaagtcaaactggtgtctttgttggttcagcaggtattgattttggtggtacacaattagctaatactcttcaaatgtctgctcatactatgactggtttagaaccatccattttctctaatcgtatttcttacatttttgatttacatggtccatcaattactagtaatactgcttgttctgcctctatgtcatctttatctatggcttgtaatgctattgctgttggtgattgtgacaaggcttttgttgctggttcaaactttttaccaactccaggtggttttgttgccttctctcaacttagagtcgtttctaaaaccggttcttgtaagccatttgatgaaaaggctgatggttatgctagacttgaaggtgcttgtatgcttttaattaaggattatgaaaaggctgttagagataatgataagatttatgccactattattagtagtggtactaatgaagatggtcgtactttatctattactctgccatcttcagatgcccaatgtgccttaatgcaatgggtttgtgaaaagagtaatatcaaggctgataccattgattacgttgaagcccatggcactggtactccaactggtgatccaattgaagctagatctatcggtaatgcatttggtaaaaaggttcgttctccaaatagtaaaccacttccagttggtactgttaaaggtaatgttggtcatggtgaattcttaagtggcgctattggtttattaaaggtttctttaatgcttttcaacagacaattggttccaactgccgcttttgaaaagttaaatccaaaaattgatgttgatggtttgggtattcgtgttgctgataaaaatgaaccattagtcaagattaatggtaagattaatactccattccgtgctgctgttaactcttttggtttt

SEQ ID NO: 26237 - DNA, 709 bp, Piromyces finnis
  PKS_KS
tgccgttattggtatgggtattcgtttaccaggtggtattaatactccaaccaagtattggaatgctttagtaaatggaaaagattgtatatcaccaactccaaataatcgtcatcttcaccatttcttaagaccaaactgtccacataacgaattaggtccatatgatcattatgttcatcgtgctggttattatgatgttgttccagatgctgcaccaattactgattttgatccaactttctttaacatttctccattagaagcaaaatttactgaaccaaagtttcgttgggtctatgaaactgtttatgaagctttccaagatgcttgtatcgatatttctgagttaaatggttctcgcactggtatttattgtactgttggtggtacatttgattacattggtttaactaaggctttcgttagtggtcaaactatgacaagtcaaactatgcatggttctgctgcttctagttgtgctggtcgtatagcatttaattatggtttcattggtccatctgataccgttgatactgcttgttccagtggtttaaatgatgtcaataatgcttgtaagtctctttcttgtggtgacactgatattgctgtagcatctgctgttcaccatcaatatgttagtactcaattccatgttatctctgttgctcacatggcttctcaaactggtcgttgtgctacctttgat

SEQ ID NO: 26238 - DNA, 1039 bp, Piromyces finnis
  PKS_KS
tgctattattggtacaggtattcgtttaccaggtgatattaataataaggatgatttctggaaggtaatgatagagaaaaaagtaattactggtcttactccagaagatcgttgggatcgtgatgaatggtattgtaagacagaaaagcccggaacaattcaaactttatatggtggttttatcgagaatgcttttgattttgataataaattcttttctatttcccaaaaagaagcattagatgctactccggaacaaagatggctttgtgaattaactgttgaaaccattgaagatgccaatattaatattgataaatttaaaggaagtaatactggtgtttttgttggtacttcaggtatagattatggtagttacgttttttcagtaccagaaaaaattacaaaatatacttatagtggaattgaaccttctattcatgccaatcgtgtttcttatcttttcgatcttcacggtccatcattatccaccaataccgcttgctcttcttcattgactgctttatccattgcttgtaattctatggccgctggtgattgtgaaatggctattgtcgctggtactaatttcttccaagctccagcaaatggtgttgcctattctcaacttcgtgttgtatcaaagaaaggcgcttgtcgtccattcgatagtggtgctgatggttatgctcgtttagaaggtgctggtatggttttattaaaaccttatgaaaaggccatccgagataataataaaatttatgctactattttaagtactgcttgtaatgaagatggaaaaactgcttctttaactactccatcttccaaagcccaatataaattaatgaagcgtgtttatgaaaagggtcatattgatccatgtactattgattttattgaagctcatggtactggtactgctgttggtgatccaattgaggctagttccattggtgaagcttatggtaaaattaataaagccaatggaaatccagccatcccagtcggatccgttaaaggtaatgttggtcatggt

SEQ ID NO: 26239 - DNA, 1284 bp, Piromyces finnis
  PKS_KS
tgctgtcattggtattggttgtcatttcccagaaggtattgaatcaaaggaatccttctggaaaatgttggaagatggtaaatgcattaccaaagatattccaaaggaaagatgggataaagatgaatggtattctaaagaacctgttcaaggaaccattcaaaccaaacgtggtgccttcttagagaatccatatcttttcgataacaaatatttttacatctccatgccagaagctaaggaaatgtcaccagaacaacgctggctcttagagttaaccgttgaaactcttgaagatgcaaatatcaaaccagaaactttaaagggttctcgtactggtgtttttattggatcatcaggtattgattacttagttacccaaatttctcatgctaatgatattaattcacacagtcctactggttttgagctttccattttagccaatcgtttgtcttatgtctttgatttccaaggaccatctataagttgtaatactgcatgttcatcagcattctctgctttaaacatcggtttaaatgctatgattactgatgattgtgaaatggctattgttgctggttcaaactttatgagttgcccaggtagttttgtagcttattctcaacttcgtgttgtttctaaagatggttcatgtaaaccatttgatgaaaaagctgatggttatgcaaagttagaaggtgctggtatgatattagttaaaccttatgagaaagctgttcgtgatggtgataagatttattgtgcaattgttggttgtggtagtaatgaagacggtcgttccccatctcttactatgccttcctatgaagcacaatataagttattaactcatgtttgtgagaaatctggtattaatccaactcaaattgattatgttgaagcccatggtactggtacaaaggttggtgatccaattgaatcccatgctataggtgatgcttatggtagaggtaagggtattcgtggtccaaatgacccacctgtattagttagttctgtaaagggtaatacaggtcatggtgaaaattctagtggtattgtaagcattattaagacttcaatgatgctttataaacgtaaattagtaccaacggccgcctatcatcgtcttaatcaagctattgatgccgaaaaattaggtattaaagtttgtgaaaaattagaagattggaatacccctcatatcttacatgctgcagtaaactcatttggttttggtggtgccaacacaaatgctttattagaagaagttaaacattt

SEQ ID NO: 26240 - DNA, 1329 bp, Piromyces finnis
  PKS_KS
tgctgtcattggtgttggttgtcgtttcccaggtaatattaaatcaaaggaagatttctgggaaatgcttactactggaagatgtcttacctctgaaactccaaaggaccgttgggattctgctgaatggtataacaaagagccaaagagaggtactgttcaaactactagaggtgcatttatggaagatgccttctactttgataataagtatttctcaatttctcaaaatgaagctaaggaaatgtcaccagaacaacgctggttattagaattagctgttgaaacctttgaagatgctaacattaatccaaagaaattaaagggttctagaactggtgtctttgtcggttcttccggtatggatttcgtagcagctcaaatttctcatgctaatgatttaactcaacactctgctactggtcttgaactttctattcttgccaaccgtatctcatactactttgatttaaatggtccatctatttgtactaacactgcatgctctgcttctatgactgccttaaatcttgctattaattccatgattactgatgattgtgatgcagctcttattgctggtactaatttattattcactccaggtagttgtgttgcatactctcaacttcgtgttgtctctgttgatggttcttgcaaaccatttgataagagggctgatggttattctcgtgttgaaggtgctggtatgttattgattaagccatatgaaaaggctgtaagagatggtgataaaatttattgtgctattttaggtagtagtactaatgaagatggtcataccccatctctcactatgccatcctatgattctcaatgtaaattattaactcatgtttgtgaaaaattcgacattgatccagcctcaattgattatgttgaagctcacggtactggtactgcagttggtgatccaattgaagctcgttcaataggttatgcctatggacgcagagttcgtgaaggtaaacaaattaagactactcgcccaggtgagactgaggaaattcttgatcaaccaacctatccattgatcattggatctagtaagggtaatactggtcatggtgaatattctagtggtattattggtatgattaaggctgttttaatgcttcaccatcgtactatggttccaactattgctcatgaggaaatgaacccagccattgatgctgaaggtttaggtattaaggttgctacaaagttagaaccatggactactccgcacactttacgtattgctgttaactcttttggttttggtggttcaaatggtaatgccatttttgaagaagttgttaatga

SEQ ID NO: 26241 - DNA, 1305 bp, Piromyces finnis
  PKS_KS
tgctattattggtatgggtttacgtcttccaggtgctatcaatagtgacaagtctttatggtctactttagttaaaggcagagactgtattacagctattccaaaggatagaaaattacatgaaaactatgttgataagcaaagtagtgaattaaacatgggtgaacataatgttaagcgttgtggctactatgactcccgttcaagtggtaaaaagatttctcaattcgatgcagaatttttcaattgccttccggatgaagctattggtcttgatccaaagcatcgttggatcttagaaacaagttgggaagctcttgaaaatgctggtatttcacctgaatcccttgaaaataccgatacaggtgtttttgttggtattggtgatcaacaagaacatgtcaagtttatgcaagaatgtcaaaaggaaaaagttgttgcccatcacaatagtaatccatcagctattgctggacgtttaagttacttttacaaactttatggtccatctgttactgttgatacagcttgttccactggtgcaacagctcttcatactgcctgtcgttctatgattttcggtgattgtaacctttccattgtgaccgcctccaaattcttattctattcagaagaatttgaaatgacaagtaaggcaagaatgacttctccatctggtcgttgtgctacttttgataagaatgctgatggttatgtcccagctgaaggttgtgtaacctttatattaaaacgtttagaagatgctgaacgtgataaggatcatattcttggtgtaattcttggtactagtagtggtcaaagtggtttccgtcaatccattagtgttccttcatcagaaggtcaagctcgtaatattgaacgtgctatggcagttgctggtgttcaaccttctgacatatcttacattgaagcacatggtactggtacaccatatggggatgccattgaaattcaaggtattaatcaagtttatgctggaagccacacctcggaacatccattagtcatcggtagtatcaagacaaatattggacatacagctgaaactgctggtttagctagcattgccaaggttttattagctatgaagaataaaactattccaagaaatcttcatttcaagaaccttaatcctgaaattgacttgggagttgttccactctccgtcccaacacataatgtgaaatgggaaactgttgatggtaaaccaagaacagctttggtatcttcttatggtttacaaggtagtgctgttaatattattctacaagaatacgttccacc

SEQ ID NO: 26242 - DNA, 180 bp, Neocallimastix californiae
  PKS_PP
cgaagttatggaattagaattgaaaaaggttcttcaatacggtgaaaatgatgaaattgatccttatcaatccttatctgaattaggtattgattccattatgatgatggaattacgtaccattttaaagaatgttacaggaattaatattcctttggtagtattctccactcaaaatat

SEQ ID NO: 26243 - DNA, 168 bp, Neocallimastix californiae
  PKS_PP
taaggatattacagaaaaattacaaagtatgttaggattaattgatgaagaaattgatgttactattccacttcgtgtctatggtttagattctttaacagctatggaattaaccaaatggattgaaagtgaaatgaatattgaattcaatcaaagtcaattattagg

SEQ ID NO: 26244 - DNA, 168 bp, Neocallimastix californiae
  PKS_PP
taaggatattacagaaaaattacaaagtatgttaggattaattgatgaagaaattgatgttactattccacttcgtgtctatggtttagattctttaacagctatggaattaaccaaatggattgaaagtgaaatgaatattgaattcagtcaaagtcaattattagg

SEQ ID NO: 26245 - DNA, 180 bp, Neocallimastix californiae
  PKS_PP
aaatgaagtagttgaaaaattacaagatttattaggtttagttgatgaaaatattgatactaatgtaccattgcaagtttatggtttagattctttaacttcaatggaaattgttaaatgggttgagaatgataaaaaagtagaactaccacaatcagctttattaagtagtgaaattac

SEQ ID NO: 26246 - DNA, 180 bp, Neocallimastix californiae
  PKS_PP
gaatgaaatatgtgatagattacaaaatatgttaggtttagtagatgaaaaaattgatccagctattccacttcgtgtttatggtttagattccttaactactatggaattaaccaattggattcaaagtgaattaaaggttacattaccacaaagtcaattattaagtgatgagataac

SEQ ID NO: 26247 - DNA, 168 bp, Neocallimastix californiae; identical to SEQ ID NO: 26244
  PKS_PP

SEQ ID NO: 26248 - DNA, 168 bp, Neocallimastix californiae
  PKS_PP
taaggatattacagaaaaattacaaagtatgttaggattaattgatgaagaaattgatgttactattccacttcgtgtctatggtttagattctttaacagctatggaattaaccaaatggattgaaagcgaaatgaatattgaattcagtcaaagtcaattattagg

SEQ ID NO: 26249 - DNA, 168 bp, Neocallimastix californiae; identical to SEQ ID NO: 26244
  PKS_PP

SEQ ID NO: 26250 - DNA, 168 bp, Neocallimastix californiae; identical to SEQ ID NO: 26244
  PKS_PP

SEQ ID NO: 26251 - DNA, 168 bp, Neocallimastix californiae
  PKS_PP
caaggatattactgataaattacaaagtatgttaggattaattgatgaagaaattgatgttactattccacttcgtgtctatggtttagattctttaacagctatggaattaaccaaatggattgaaagtgaaatgaatattgaattcagtcaaagtcaattattagg

SEQ ID NO: 26252 - DNA, 168 bp, Neocallimastix californiae
  PKS_PP
caaggatattactgaaaaattacaaagcatgttaggtttaattgatgaagaaattgatgttaccattccacttcgtgtctatggtttagattctttaactgctatggaattaaccaaatggatagaaagtgaaatgaatattgaattcagtcaaagtcaattattagg

SEQ ID NO: 26253 - DNA, 168 bp, Neocallimastix californiae
  PKS_PP
caaagatattactgaaaaattacaaagtatgttgggtttaattgatgaagaaattgatgttaccattccacttcgtgtctatggtttagattctttaactgctatggaattaaccaaatggattgaaagtgaaatgaatattgaattcagtcaaagtcaattattagg

SEQ ID NO: 26254 - DNA, 168 bp, Neocallimastix californiae; identical to SEQ ID NO: 26252
  PKS_PP

SEQ ID NO: 26255 - DNA, 162 bp, Anaeromyces robustus
  PKS_PP
tgaaatcttaaagagagaagttcgtagaatgttaatgtataatgataatgatgaattagatgaattacaaccactttctgaattaggtttagattctattatgatgatggaattccgtcaaattattaaagctgttactaacattgttgtaccactttccat

SEQ ID NO: 26256 - DNA, 180 bp, Anaeromyces robustus
  PKS_PP
tgctattatggaaagtgaattaaagagaattcttcaatatagtgaaaatgatgaaattgatccatatcaatctttaacagaattaggtattgattctattatgatgatggaattacgtactattttaagaactgctacaggtgtaaatattccattagttgttttctcaacacaaaatat

SEQ ID NO: 26257 - DNA, 216 bp, Anaeromyces robustus
  PKS_PP
aaagattatttgcaaaatttattcgaatgtatttaatattaacgaaaatagtgttggattaatgaatgaattttatgaacttggaggtgacagtttaattgttattagtattttatcattaattgaaaaagaattaaagataaaattaaatgttaaagatattctttcacatcctttaattaaagatttatgtgattatatagaaactattttaag

SEQ ID NO: 26258 - DNA, 216 bp, Anaeromyces robustus
  PKS_PP
aaaattaatatgtaatgtatatagtaaaacattaaatattgatgaaagtaaaattggaaaaatgagcgatttctttgaattaggaggtgatagtttaaacgctataagaattatatcaatgattgaaaaggaattgaatataaaactctatataaaagatatattatcgcatcctttagtaagtgaaattagcgaatatattgaagatatattaac

SEQ ID NO: 26259 - DNA, 180 bp, Piromyces finnis
  PKS_PP
tgaaattatggaacatgaattaaagaatgttctccaatacggtgaaaatgatgaaattgatccataccaatctttaactgaattaggtattgactctatcatgatgatggaattacgtactattatgagaactgccactggtatcaacattccattagttgttttctccactcaaaacat

SEQ ID NO: 26260 - DNA, 171 bp, Piromyces finnis
  PKS_PP
agatattttaaagaaagaaattcgtagaatgttaatgtacaatgaagatgatgaaattgacgaaatgcaaccactttctgaattaggtatggattctattatgatgatggaattccgccaagttattaaagctgtcactgatattatgattccactttctattatttcttc

SEQ ID NO: 26261 - DNA, 168 bp, Piromyces finnis
  PKS_PP
taaggatatctctgaaaagttacaaagtatgttaggtttaattgatgaagaaattgatgttactattccacttcgtgtctacggtttagattccttaactgctatggaattaaccaaatggattgaaagtgaaatgaacattgaattcagtcaaagtcaattattagg

SEQ ID NO: 26262 - DNA, 168 bp, Piromyces finnis; identical to SEQ ID NO: 26261
  PKS_PP

SEQ ID NO: 26263 - DNA, 168 bp, Piromyces finnis; identical to SEQ ID NO: 26261
  PKS_PP

SEQ ID NO: 26264 - DNA, 168 bp, Piromyces finnis; identical to SEQ ID NO: 26261
  PKS_PP

SEQ ID NO: 26265 - DNA, 168 bp, Piromyces finnis; identical to SEQ ID NO: 26261
  PKS_PP

SEQ ID NO: 26266 - DNA, 168 bp, Piromyces finnis; identical to SEQ ID NO: 26261
  PKS_PP

SEQ ID NO: 26267 - DNA, 168 bp, Piromyces finnis; identical to SEQ ID NO: 26261
  PKS_PP

SEQ ID NO: 26268 - DNA, 180 bp, Piromyces finnis
  PKS_PP
gaatgaagttattaccaaattacaagatttattaggattagtagatgaagaaatagatgttaacgttccattacaagtttatggtttagattctttaacttcaatggaaattgttaaatggattgaaaatgataagaatgttgatcttccacaaactgcattattaaatagtgaaatcac

SEQ ID NO: 26269 - DNA, 219 bp, Piromyces finnis
  PKS_PP
tttaatttatcaatccattaaagaaattataccatctactccagattttgatcaatttgatccagaaatgtcattcactatgtatggtatcgattctctctctaccgttaaattaacaaatattttatcgagaaagttaaagaagaactattctccttctattattttcaattatgcttctccacttttacttgctcaatatttatctcaaccaactca

SEQ ID NO: 26270 - DNA, 126 bp, Neocallimastix californiae
  Plant lectins/antimicrobial peptides
tggaagagattatggaaaatgtcctgatggtttatgctgttcacaatatggttggtgtggcgtaacaagtgattattgtgataataattgtcaacctgaatttggtagatgtaataatatggctgc

SEQ ID NO: 26271 - DNA, 129 bp, Neocallimastix californiae
  Plant lectins/antimicrobial peptides
tggaatcttttccggtaaaagatcttgttctaataatgaatgttgttcttcctctactggttattgtggtcgtaacgatgactactgtggctctgactgtcaaagtgaatttggctattgtacctccag

SEQ ID NO: 26272 - DNA, 126 bp, Neocallimastix californiae
  Plant lectins/antimicrobial peptides
tggcaaaggatatggaacttgtcctgatgatgaatgctgttctcggtatggttggtgtggtacaacaagtgaatattgtggttataaatgtcaatctgattatggaagatgtgataatataagtct

SEQ ID NO: 26273 - DNA, 126 bp, Neocallimastix californiae
  Plant lectins/antimicrobial peptides
tggtaaaggttatggttcatgcccaaataatgaatgctgttcacagtatggttggtgtggtacaactagtgaatattgtgattataagtgtcaattggattacggtagatgtaataatataagttt

SEQ ID NO: 26274 - DNA, 126 bp, Anaeromyces robustus
  Plant lectins/antimicrobial peptides
atgtggtaaaggttatggttcatgtcccgataatgcatgttgttcacaatggggttggtgtggttttacatcagatcattgtggtgcaggatgtaataaagaatatggtagatgtgataatgtaga

SEQ ID NO: 26275 - DNA, 585 bp, Piromyces finnis
  PLC-like phosphodiesterases
gagtaaatatcttaataatacaaggatcaatcaaattaatattcctggtactcatgatagtggaacatatgctgtagattggcattcttttcctattataaatggctttagaagacaatggggaagaactcaatctttagatatatatcaacaattaatgcatggaattagatatttagatataagacttgaaactaatccaaaaaaacaaatatatcttactcacgataaatttgattgtattaataaaaaaactaatgatttgtactatttaagtaatgtatttgatgaagctattaattttttacattataatccaagtgaaactgttattatgcatttaaaatgtgataattgtcatttccataagtataacaaagatggtagtatgaaagaaaaaggtgatttaaaagaggaagaattttatgaagcaattgctaatcttagtataaataattctgatagaccatatgaaaaattttataaagattatttttatcaagataataaaagtaatgagttatttccaactcttggaaaagcaagaggtacaataattatttatacacgtggagattacaaata

SEQ ID NO: 26276 - DNA, 195 bp, Piromyces finnis
  PLC-like phosphodiesterases
ttatgatagaaataataatgatgtacttactataaattttatgaatatacaggctgtgtgggaagtttttagtagtgtttatacacatgctagtagtataaataaaaaattggttgaatattttaataataataatccaaaaatacacaatcaatggatgattttagattttccagatgttcatttaacacgcaa

SEQ ID NO: 26277 - DNA, 78 bp, Piromyces finnis
  PLC-like phosphodiesterases
tggtaataattatcttgtacaagataattacaatgcaggggttaatgaaaaatggtctattattaaagatatgttaga

SEQ ID NO: 26278 - DNA, 78 bp, Piromyces finnis; identical to SEQ ID NO: 26277
  PLC-like phosphodiesterases

SEQ ID NO: 26279 - DNA, 594 bp, Piromyces finnis
  PLC-like phosphodiesterases
taattggatgagtaaatatcttaataatacaaggatcaatcaaattaatattcctggtactcatgatagtggaacatatgctgtagattggcattcttttcctattataaatggctttagaagacaatggggaagaactcaatctttagatatatatcaacaattaatgcatggaattagatatttagatataagacttgaaactaatccaaaaaaacaaatatatcttactcacgataaatttgattgtattaataaaaaaactaatgatttgtactatttaagtaatgtatttgatgaagctattaattttttacattataatccaagtgaaactgttattatgcatttaaaatgtgataattgtcatttccataagtataacaaagatggtagtatgaaagaaaaaggtgatttaaaagaggaagaattttatgaagcaattgctaatcttagtataaataattctgatagaccatatgaaaaattttataaagattatttttatcaagataataaaagtaatgagttatttccaactcttggaaaagcaagaggtacaataattatttatacacgtggagattacaaata

SEQ ID NO: 26280 - DNA, 195 bp, Piromyces finnis; identical to SEQ ID NO: 26276
  PLC-like phosphodiesterases

SEQ ID NO: 26281 - DNA, 348 bp, Piromyces finnis
  PLC-like_Pdiesterase_TIM-brl
taattatcttgtacaagataattacaatgcaggggttaatgaaaaatggtctattattaaagatatgttagatcataatatactaacaacatgggataaaaataaggatatttttaatatttatggaaaggatcatgctaatactactatgttttatgatagaaataataatgatgtacttactataaattttatgaatatacaggctgtgtgggaagtttttagtagtgtttatacacatgctagtagtataaataaaaaattggttgaatattttaataataataatccaaaaatacacaatcaatggatgattttagattttccagatgttcatttaacacgcaa

SEQ ID NO: 26282 - DNA, 672 bp, Piromyces finnis
  PLC-like_Pdiesterase_TIM-brl
gagtaaatatcttaataatacaaggatcaatcaaattaatattcctggtactcatgatagtggaacatatgctgtagattggcattcttttcctattataaatggctttagaagacaatggggaagaactcaatctttagatatatatcaacaattaatgcatggaattagatatttagatataagacttgaaactaatccaaaaaaacaaatatatcttactcacgataaatttgattgtattaataaaaaaactaatgatttgtactatttaagtaatgtatttgatgaagctattaattttttacattataatccaagtgaaactgttattatgcatttaaaatgtgataattgtcatttccataagtataacaaagatggtagtatgaaagaaaaaggtgatttaaaagaggaagaattttatgaagcaattgctaatcttagtataaataattctgatagaccatatgaaaaattttataaagattatttttatcaagataataaaagtaatgagttatttccaactcttggaaaagcaagaggtacaataattatttatacacgtggagattacaaatatacaaaaaataatcagacaattcaaataggcaaaaaaatagatattccaggaatgggttcttgtgatgatctttcatgggttagtta

SEQ ID NO: 26283 - DNA, 681 bp, Piromyces finnis
  PLC-like_Pdiesterase_TIM-brl
taattggatgagtaaatatcttaataatacaaggatcaatcaaattaatattcctggtactcatgatagtggaacatatgctgtagattggcattcttttcctattataaatggctttagaagacaatggggaagaactcaatctttagatatatatcaacaattaatgcatggaattagatatttagatataagacttgaaactaatccaaaaaaacaaatatatcttactcacgataaatttgattgtattaataaaaaaactaatgatttgtactatttaagtaatgtatttgatgaagctattaattttttacattataatccaagtgaaactgttattatgcatttaaaatgtgataattgtcatttccataagtataacaaagatggtagtatgaaagaaaaaggtgatttaaaagaggaagaattttatgaagcaattgctaatcttagtataaataattctgatagaccatatgaaaaattttataaagattatttttatcaagataataaaagtaatgagttatttccaactcttggaaaagcaagaggtacaataattatttatacacgtggagattacaaatatacaaaaaataatcagacaattcaaataggcaaaaaaatagatattccaggaatgggttcttgtgatgatctttcatgggttagtta

SEQ ID NO: 26284 - DNA, 348 bp, Piromyces finnis; identical to SEQ ID NO: 26281
  PLC-like_Pdiesterase_TIM-brl

SEQ ID NO: 26285 - DNA, 546 bp, Piromyces finnis
  PLCXc
caatcaaattaatattcctggtactcatgatagtggaacatatgctgtagattggcattcttttcctattataaatggctttagaagacaatggggaagaactcaatctttagatatatatcaacaattaatgcatggaattagatatttagatataagacttgaaactaatccaaaaaaacaaatatatcttactcacgataaatttgattgtattaataaaaaaactaatgatttgtactatttaagtaatgtatttgatgaagctattaattttttacattataatccaagtgaaactgttattatgcatttaaaatgtgataattgtcatttccataagtataacaaagatggtagtatgaaagaaaaaggtgatttaaaagaggaagaattttatgaagcaattgctaatcttagtataaataattctgatagaccatatgaaaaattttataaagattatttttatcaagataataaaagtaatgagttatttccaactcttggaaaagcaagaggtacaataattatttatacacgtgg

SEQ ID NO: 26286 - DNA, 546 bp, Piromyces finnis; identical to SEQ ID NO: 26285
  PLCXc

SEQ ID NO: 26287 - DNA, 867 bp, Neocallimastix californiae
  PLP-dependent transferases
caatatagctaatgtcgcattattcactactttagtaacaagatcagattatatattttatgattcatcaagttctaaacatgtattagatgctatatcattttcaaaagctaaaactttatcttattcacatgttaatgctattgaaaatattgaaaatcaagttaaacttgtacatgaaaaattccccaaaagtaaaaaagttattgtttcatcaagtatttttatgaatgaaggggatatatgtcaattaaaagatattcatagaattgctcaaaattatcaatgtatagttgttattgatgatacatttggttgtggtttctttgatggctcatccaataatattcttgaattttttaaatttaaaggtcaaatagattttattacaggttctttctctggaattatggaatctaatggtggttttattgtttacggagaaaatcaaaaatcatttatgaattctttaaaaataaattatgaaagagatgctattcttccaaataccgccggcgctctcctcgctagttatcaatgtttggagactcctttaaatacatcatcctctggtaagattaatcgtcgtcttcaactctttaaaaatattcttcattggaaaaatggattaaagcgtattggattagatataccaaatcattccaaatcaacagtcattcctatttttatgccaacaaatgaatctggaatcgctgttcaaaaggcattacaaacccaaggattatatgtttcctatgaatccaatgaaaaagatgttcaacaccactataaaattattacttccattcaaactcgtatgacaagtgatgaaatagatcaagccttagaaattatgggtcgtgtgat

SEQ ID NO: 26288 - DNA, 1089 bp, Neocallimastix californiae
  PLP-dependent transferases
ttcagaatgtattgatattgcttgtccaacaaatagaaaaattaatttctgttctacttcttatcttggtttaaatcaagatccaagaatgaaacaagctgcttatgaagctattgaacaatatggtttaagtcctcttggtagtgcaccatttggtggtttaacaaatcttcatgaaaaattaggttaccgtttaggtaaaatatatggtttaccatatggtattactacttctggtgctacccttgctaatatgactattattccattaattgttggtgctaaggatttcgttttttcagatgaattaaatcacactaccatcattgatggtattgatttatctaaagcaaaaatgattaaatataagcacaatgatatggaagatttagaaaaaaatgttaaactaattcatgaaaaattcccaaatagtgtaaaattaattattttcgatggtgtatttagtatggaaggtgatgtctgtgatttaccaaacattgttagaattgctaagaaatataattgtaaaacaatgattgatgaatgtcatgctcttggtattattggtccacacggttatggtacattagattattttaatatgccaggatctgttgattttgtaacaggtacattagttaaatctctttgttctcatggtggttatatttgctgtagaagagattatcaaaataagttagaaaattcaagcggtattattttttctacaaataatacaccagcttatgctgctacttcattaaaggctctcgatttaattgaagaagaaggtccaaatagtgttcgtgctagacttcaacgtaatgtcaagcattggaaagaaggtgttcgtaacctcggttttgaaattattgaaggtgtcagttgtgtttgtccaattatgatttatgatgaaattaatggtttaaagtttcaaaaacgtttatatgaagaaggtttgaatttctcagctgttgctttcccagctgttccaaagaatatggctagattaagaactactgttttaggttcactcactgatgaagatattgatgaagctttaagtattttaggacgtgttgctcaaca

SEQ ID NO: 26289 - DNA, 1005 bp, Neocallimastix californiae
  PLP-dependent transferases
caagttgatcgatttatcttttcattcatatttaggtttaaaccagaataaacaattaaagttaaccacatgtaatgttataaatgaatttggatgtggtattttaaagggaattacttcatatcatgaaaagactgaagatattttaaaatctatttatcaatttccaagttgctataccctttcaggagatggaaattcttttattattccattaatagtcggaaaaaatgatgcaatatttattgatgaatgtgctaaaacatcaattaatgacagtgctgaattatcaaattcaaaaatttattattataagcataataatgcttctggtcttgaagcttgtcttttgaaggccagtcaggaattaccaaatagtaagaaacttattattatagaaggtgtatataatattactggtgaaatttcaaatttagttgagtttataaatgtctcaaaaaaatttggaggcattgtgttagttgatgaaagtcatgctcttggtgtacttggaaaagagggtaagggttcattagaatatgcaaatattcatgaaggtgttgatgtaattactggttcattagaatattcactttgttcaaatggatcatacattcttttaaataatgaattaagtaaacaatttaatgatttaatatttataaatgatacaattactccattaagtgctgctatttcaagtacaacattagatattttaagacaggattcgaagacagttgatcaattaaaaaataatgtatcatggtggaggagtcattgccaacaaaatggtatagaattaattgatagtaattcagctatttctgcaattagaattgatgataagggtattttattaaatcttcaaaggagattatatgatgaaggattaaatgttatggtaagtacaaggccatatggtttattaaaattcattctttctgcctcattaactgaagatcttttagaagaagctatggatatattattacgtgttatagt

SEQ ID NO: 26290 - DNA, 1083 bp, Neocallimastix californiae
  PLP-dependent transferases
ttcaaataaattcataaatttcaattcaacatcttatctttccctaaataaagaattaaaagttaaacttgtagctgaaagagtgataaaggaatatggtataggatcctatggtatttttacaccatatcatgttgaattatatcaacatttaaaggaaatttatggtgaagattatgatcatattcaaacctatcagggagatatacgtgatgtcttcttctcaaaattatttgattccaacgatttcattttctatgatgaacaattaaacagctcattcagacaagtcttgagagcattacatttcaagaagaatcaactcgttgaatttaatcataatgatgcatttgatctttctgaaaaattagaagctattgatttaatttcacctgatgctcataaatatattatcacggaaggtgtttttgaattacaaggggatttatgtcatcttcaagatattttcaatatttcaaaaaaatatgattgttatgttattttagatgaatccaatgccttaggtgttattggtaaggaaggattgggttcctacaattatcatcaatgtcaggaaaaggcagatattgtattttgctctatggataaggtgctttgtgccagtggtcaattttatgtatttaaccaaagaatttcaactctcctagcaagacgtctcactgaccttttcaatgaaacaatttatccaccagtaagtacattagctgctgctgtcgctaaaaccgtattggatattattgtcgaagattctgttgatttcaaaaatgttggagaggacaccactggtgttcatgctcaattaatggataaaattaaatattggaagaaaaaatgtcaaagtattggcttaaaatttattgaaagtccatctccaatgacttgtatgattttagatgaaattgatactgaatcgttggctcaactcttatttaaaaataaaataaaatgttcttatgtatgtcataaaaaaaatatgaattataatttgttaaaatttaatattataagatccatggatttaagacttttggatgaagcctatcatatattacaatcggtatt

SEQ ID NO: 26291 - DNA, 1053 bp, Anaeromyces robustus
  PLP-dependent transferases
aaaaagtttaaatttttgttcttcattaccatttgaatttgggaaaataagtactgttaaaaaggcagctgtagaagctattgaattatatgggttaaatgctgataatcaatgtccattaaaaatacagttagaaaaaaaattatcaaatgaatatgattatccatattctactgttttttctggagccaatatttgtaatgttgcattatttactacattggcaacaaaaaatgattatattttttatgattcatcaagttcaaaacatgtattagatgcaatttcattttcaaaagccaaaatattatcttattcacatgtaaacgctatagaaaatttagaaaaacaagttaaaatcgttcatgaaaaatttccaaatagtaaaaagattatcgtttcttcaagtgtatttattaatgaaggagatatttgtcaattaaatgatattaataaaattgctcaatcttatcaatgtattgtagttattgatgatacatttggatgtggttattttgatggttctgctaataatattcttgaattttataaattaaaaggtcaaattgattttatttgtgggtctttttctggtattatggaatccaatgggggattcattgtttatggtgaaaatcaaaaatcatttatggatttaataagtaaaaattatgaaagagatgctatcttaccaaatatagctagtgctattttagctagttatgaatgtttagaagtaccattaaattcatcaattggtaaaataaatagacgtcttcaactttttaaaaatatgcttcaatggaaaaatggtttaaaaaaaattggtttagatattccaagtcattctaaatcagctactcttccaatttttatgccatccgatgatattggtatggcagtacaaaaggcactacaagaagaaggtttatacgtttcttatgaatctaatgaaagaaattctgtacataaatataaattattaacttcaattcaagtaaatatgactaaagatataatagataaagctttagaaattattggtcgtgttac

SEQ ID NO: 26292 - DNA, 765 bp, Anaeromyces robustus
  PLP-dependent transferases
tattaatgaaggatctaaaacatcaataaaagatggagcagaattatcaaatgcaaatgtctattattataaacataatgatatttcaagtcttgaagctagtcttgtgaaggctaatcaggaattaccaaatggtaaaaaacttataacagttgaaggggtatatgaaataacaggggaagttgttaatttaagtgaatttattacagtagctaaaaaatatggtggtttagttttattagatgaaagtcatgcacttggtgttcttggtgctaaaggtaaaggttcaatggaaaatgctaatattcatgatggtgtagatattattactggttcattagaatattcactttgttcaaatggttcatatttccttttgaatcaaaatttaagtcaacaatttagtgatttaattttcattaatgatattattactccattaagtgccgctatttctagtactactttagaaattttaagacaagatgcaaaaatgattcaacaattaaaagataatatttcatggtggagaagtcattgtcaacaaaatggtattgaattaattgatagtaattcagctattgctgctataagaattgatgatgactctgttttattaaatcttcaaaaaagattatatgaagaaggattaaatgttatggttagtaacaatccatatggtttattaaaatttattttttctgcttcattaactgaagatcttttagaagaagctatggatattttattacgtgtattaactaa

SEQ ID NO: 26293 - DNA, 1005 bp, Piromyces finnis
  PLP-dependent transferases
gtccatcgatttatctcttcattcatatttaggtttaaatcaaaataagcaattaaaattaattacttctcaagttattaatgaatttggttgtggtatttttagaggattaacaacatatcataagaaaactgaagatattttaaaggccatttatcaatttccaacatgctatacgctttctggagatggaaattcatttgttattccattaatggttggtaaaggggatgctatttttgttgatgttgaagcaaagacttcaattaaagatggttcagagttatcaaatgctacagtctattactatagccataacgatccaattagtcttgaatcatgtcttttaaaggcaaatcaagaagtaccaaatggtaaaaagcttgttgttattgaaggtgtttataaaatatctggtgatgttgctaaattaaatgaatttattccaattgccaagaaatatgacgctactattttagtagatgaaagccatgcacttggtgtacttggtgctagaggaagaggttcattagaacaatttaatgttcgtgagggtgttgatattattactggttcattagaatattctctttgttctaatggatcatattttcttttaaataaacaattaactcaacaatttagtggctttatctccattaatgatacaattactccattaagtgctgccattgctagtactacattagatattttaagacaagatactaagatgattgaacaattaaaaagtaatatttcatggtggagaactaattgtcaacaaaacggtattgaattaattgacagcacatcatcaattactgctattaaaattgatgacgaaaatgttttattaaatcttcaaaaaagattatttgaagaaggattaaatgtaatggttagtacaagtccatatggtttattaaagttcatactctctgcttctttaactgaagatcttttagaaaaggctatgaatattttattacatgtattgtctaa

SEQ ID NO: 26294 - DNA, 1083 bp, Piromyces finnis
  PLP-dependent transferases
tacaaataaatatttcaactttaaatcctcttcatttctttcattaaataaagaattaaaggttaaacttgaagcagaaaaagctattaaagaatatggtttaggatcttacggtatttttactccttatcatgcggaattaacggaatatatagaaaaaatttatggggaagattgttctattcgaacttttcaaaatgatatacgtgatattttatttaatagtttggttagttctcaagattttattttcattgacgaacaattgaacacttcttttaaacaaacaataaaatcattattcttagaaaagggtcatattattgaatatactcataatactccacttgaccttaaatctcaattaaaagcaatccaattaaaatttccaacagtaaataaatttataataaccgaaggtgtttttgaaaatataggggatgtttgttatcttaatgatattatggatatatcaaaagaatttggatgtactcttgttttagatgaatcaaatgctttaggggttatcggtcaaaaaggatttggttcatatgactatcaccaatgtcaacaaaaagcagatattattttttgctctatggataaaacactctgttctagcggtcaattttatgtatttaataataaaagtattagtatattattaaaaaataatactagtctctttgatgaatccatatattacccaataaatgcattatcagctgctgttgctaaaacagtcttaaatataatttttgaaaatactacagattttaaaaatataacatcttccatagatgttcacactcaactagttgataatattaattattggaaacaaaaatgtcaaagtattggcttaaaattaattgacagtccttctgcaattacttcaattattattgatgatgtagatgctgaatctttagttgaacttttatttaaaaataatataaaatgttcatttaccaaacaaataaatcataatattaatacaaatattttaaaattcaatatattaagatcaatgactaaaaaattcataaatgaagcctttaacattttacaatcagtattaat

SEQ ID NO: 26295 - DNA, 1053 bp, Piromyces finnis
  PLP-dependent transferases
taaaactttaaatttttgctcttctttaccatttgaatttggaaaaattgacaaagttaaaaaagcagctatagaagctattgaaaaatatggtttaaattcagatatacaatgtccattaaaaatacaattggagcaaaaattatcaaaagattatggatatcaatatgctgctacattttctggcgccaatgttgcaaatatatcattgtttaccacattagtaacaagaatggattatatattttatgattcttcaagttcaaaaaatgtaatagatgctgttttattttcaaaagcaaaaacattatcatattcacacgctaatgctatagagaatttagaaaaacaagttaaattagttcatgaaaaattcccaaaaagtaaaaaagtcattgcttcatcaagtatttttgtaaacgaaggtgatatatgtcaattaaaagaaataaatagaatagctcaaacttatcaatgtatagttgtaatagatgatacatttggttgtggtttctttgatggttcatcaaataatatacttgaattttataaattaaaaggtcaagttgattttataacaggttcattttcaggaatcatggaatcaaatggtggatttattgcatatggtgaaaatcaaaaggaatttatggatcgtattattaaaagaaatgaaaaagaagttatcttaccaaatactgccaatgctttattagctagctatagtagtttagaagaaccaatgaatttatcttctggtagaatcactagacgccatcaactttttaaaaatattcttcaatggaagaatggtttaaaaggtataggtttagacgttccaagtcattcaaaatcagcaaccattccaattttcatgccaactgatgatgcaggaatcgcttttcataaagcattacaggaacaaggtttatatgtatcatatgaatctagcgaaagagatgctatacataaatataaaatattaaccactgttcaagcaaataaaaccaaagatgaaatagatagtgcattaaaaattatcggtcgtgtagc

SEQ ID NO: 26296 - DNA, 1074 bp, Piromyces finnis
  PLP-dependent transferases
tattgcttgtccagcagatagaaaaattaatttcagttctacttcttaccttggtttaaatcaagacccaagaatgaaagaagctgcttataaagctattgaacaatatggtttaagtccacttggtagtgcaccatttggtggtttaaccaatcttcatgaaaaattaggataccgtttaggtaaaatttatggattaccatatggtatcactacttcaggagctactcttgctaatatgactatcattcctttaattgttggtgcaaaggatttcgttttttctgatgaattaaatcatactactattattgatggtattgatttatcaaaggctaaaatgattaaatataagcataatgatatggaagatttagaaaaaaatgttaaattaattcatgaaaaattcccagatagagtaaaattaattatttttgatggtgttttcagtatggaaggtgatgtatgtgatttaccaaatattgttagaattgcaaagcaatacaattgtaaaactatgatggatgaatgtcatgctcttggtattattggtcctcatggttatggtactttagattacttcaatatgccaggatcagtcgattttgttactggtactttagtaaagtctctttgtgcccatggtggttatatttgttgtagaagagattatcaaaataagttagaaaattctagtggtattattttctctacaaataatactccagcatatgctgctacttcattaaaggcccttgatttaattgaagaagaaggtccaaatagtgttcgtgctagacttcaacgtaatattaaacattggaaggatggtattcgtaatcttggttttaagattattgaaggtgtcagttgtgtttgtccaattatgatttatgatgaaattaatggtcttaaattccaaagacgtttatatgaagaaggtttaaacttctcagctgttgcttttccagctgttccaaaaaatcaagctagattaagaactactattttagcttcacttactgatgacgatattgatgaagctttaagtattattggacgtgttgctcaaca

SEQ ID NO: 26297 - DNA, 5925 bp, Neocallimastix californiae
  POLYKETIDE SYNTHASE-RELATED
tattgctcatgccacagctcttgacttttctccattattcaaacaatccaacttagaatatcttagtcaattaattatgaccatgaaacaaatgactcaaaaaccaggtgttaatccagaatatcaaaatttaattcaagttgctgttgttggtattgctttaagacttccaggtggtatcaataccgttgataagtattggaagagtttagaaaatggtagattttgtgtctctccaacaggtactaaccgtcatcttcaccataacatgactcacaatgaggaactaaaaccaggagaacattacattttcaactactgtcgttatgatagtactccagatgcagctcctatcactgattttgatccaatgttctttaatatgaatccaaatgaagccactgttcttgatccaaagttccgttgggtcttagaaactacttatgaagttttacaagatgctggtattaacccagattctctctctggtactcatactaatatttacactgcccctggacaagttgatgaaatgaatgcttatgctactaatgcctctccaactggttacagtgttcttaatggtatgagtatgcatagttgtgcttctgcttccttaccaggtagaattagtttcatgtataatttatttggtgctgctcacaccgtagatactgcctgttcttccggtttagttgctatccatgatgcttttaaggatttgaatattggtgaaactgatcttgccattgtgaatgctgctcactgtccattccaaagttcttctttcagtcttttatcaatagcaaaaatggtttccagaaactgtagatgtgcttcttacgatgaagcagcagatggttacgttccaggggaaggttgtgtttccgttattttaaagagaaaggatgatgccattcgtgatcataataagatttatggtttaattaatgctactgctgtcggtcaaagtggttccagagcttctatgagtactccaacggttctcggtcaaaagtacattcataaaaaggtccttgaaaaggctaatcttactccaggagatattgattatatggaaggtcatggtactggtaccaaattgggtgatcgtattgaagctgaagctattaatgaagttttcaagggtactcactctgagagccgtccattaaccttagctagtgtaaagactaacattggtcacactgaagaagttagtggtttagcttctttggttaaggttttattagcaatgaagcataagaccgttcctcctcatcttcacttcaataagccaagtcctttgattgattttgattccgttccattacacattccaactcaaaaggaagaatggaagccagctgaaggaaagaaacgtgttgctttagtttcttcctacggtctttcaggtagtgtctgtgatgctatcgtagaggaatacattgatcccgaagaaagagagatctatccagtcaatgatacttatcatgttcttacgattagtgccaagaaccattctgctttaattgcggttgccgaacaatacattagtcttttggaatctcttgaggctgatgctccaattgctgatctctgttactccagtaatgtttgtcgtcaacacatgaactacagatacgctgtgactggtagaaatgcttctgaattagccgccgaattaactaattatgtcagccaaggaaagaagaccatacgtactgataagcatgaagtaggtatgtccttcacaggtcaaggcagtattaagccaggagttggtaaggaattatttagaacccaacccgtcttccgtgccgctatggaaaagtgtgatgctgtggttaagaagtctaccggaatttctattcttgatgccctctatgatcaaaatcaaggtcatcacttaaagaaggctcaaattgctcaacctgctttattcgcttatgaatatgctatgtacatgctttggaaatcttggggtattaagccagtcattgttaatggtcacagtttaggtgaaattgttgccgctgccgccaccggcgctatagatattgatttagccattgatttcattattgaaagagccagatgcatgggtgaatatggtgaaaagccaggagctatggttagtgttttccaaagtgaagatgtcgtcaaggaagcaattgaagaatttggttatgaagaagaagtttcaattgccgctatcaatggtgtaactcatactgttatttccggttatgaagatgaagttgatgatcttaccgagtatttcaatgaaatgaaggttaagactaaaaagttaaacgttaccgatgccttccattctccattaatggacccagccattgaagaattaaatggttggattgaagaaaagaatgatgcccagttcagacaaactttaaaggtaaagttcatttccaacgttgatagtaccattaagcctgtcggtgatcgtcttgaaaaggattactggggtaagcatgctagaaatgccgttcgtttcgttgacggtgtaaagtctatgattgaatccgaaaagaagttattggctgtcattgaagttggtccagccgccacgttgaccaacatgagttctcgtttcgttcgtgaaacagaatctcttcgtggtaagggtccaaccttcattgctagtagtgttgccgatcaaaatagtgagcaatacttgtacaatgctcttgccaaattctacatgttaggcggtaacattgattggactagcttccacaagcgtgttgatccagtctccggtaaggctattactcttggtctctacgatcttccactctatccattccaaagatctcgctactggttggagacggaagaacaatgtcttaagccacttcaagcaggttcaaacgctgccaactgggatctctataaatcaattaccgtcgtcaataccggtaagaatgaacttgttgtcacagctccattaactccacaatacgtgaaatatttatgtaagaatcatgtcgtcagtggtaatggttgtgttccagctgcagcctacaccgaattcatctttgccgctgtgaaggccatgaataataataccgatgacgttatcgaaatcgctgatgaactcttagttcgtggtccattaaccattaaggaagattccgaggtggactttatcttaaagaaaaagggtgatcgtctttctctctacactaaattagatggtggtatagaaaatcatatgttaaacgcttccgctaatctcttaagagatggtgaaaacgtcaatattcgtgataccttaccaacgccagcccaagctaaggctttaattaataaaatcttaaccaaggataacattcattcctccaagctcatctatgacagtatcagtaaaaatattagctacaatggtggattcccatccgtgaaacactttggtcttggaaatgatgatgatggtcagtacgttcttgtctctcgtattgattcgaaggataagacccttaacaatattcgttcaggtcttaatcaggtttatctcttcgatgcctcgctccactccaatgccggtagaagtagtattgaggaggagaagaagggagaaggtcgtgaggaagaaaatgaacctttccttccttcctcttttgaaaatattatcaagttcaaagcaactccagatgaatgctttgttgttcatagatatattggtaacaccgatccaaactctgaattcactaccttctctgtttacgatttagatggtaatatttgtgaatatgttggtgccttccaaactcgtaaagttaaaattgaaacgaaggaaaccagcccagaattcagtctttggtccattgacttcaaggaagttccaaccccagttcaagaaattaatactacaccttacttctaccttctcgcggatcatcatggctatgcagatgctttcgttaaatacatgaccgctaaggttaaagatttccgttatgtcaaggtggacatgccaactaaggaagaatgtaccgatgaatttgttgaaggaaaccttaacgctttaggcataaaggaatctggtatggagaatgaaacacttgccgtcgtaaactttatgggtatggatttagaacgtcaattcgtttcctccattgatgctaaggatgcccacttctcagagctattaaagaacacctatgaacgtaatttagtgttcattcaatcgtttactcgtgttgtggatgagtatgactgtcaaaagtcattctgttacgttacgaagaacgctactgattactggaagggtgaagtggatgtcttacaaggtattatcagtggtatctctaagagtttctggagagaatatactcaaatacgtgtctttgatttagatgttgactacaccactacaccagatgaactcagtccacgtctccataccgaagtgatctctagtgttgatcgttacaacgtcacctatgaagtcgtctacggtaaggaaggtcatcgttatgaaggtaagattaaacatgtcgtggcaccaagcgtcgagtactctagtgaagttgaatttgaatacagtggtacgattttaattaccggtggtcttggtggtgtcggtttcgatatttctcgctacttgatgagacaacccaaccttaaggctcttgtacttactggtcgtagaccagaaacggatgaaaaggtagccggtaagttagccgaacttcgtgccctcaatccaaagattaaaattacctatgttaccgccaatgttggttctgaaaccgagatgaagaaggtcattgacgatattaacgctggaagtccagaagaagctttagttggtgtcttccacacagccggtactaatgatgatggtttaatctttaaccaatcgtatgaacgttttgccaagttaattaatagtaagattgaaggtacactttgtattgctaagcttactaatgatttgaacttgaagttcacaatactcttctcttcgatgaccgccttctttggtaatcgtggtcaaattaactactgtaccgctaatatgtttattaataaggtctgtgactactaccgtaatcatggtcgtaaggatattctttctcttgaattggcaggttggccatctggtctttctacaatcattaaggatttgaccttcacattgaatggtaaaaacagtattagccttatttctaaccttatgcttcatgtgagcgatattccatacgctgttcttggttctccagtagttaattgggaaaatgtttatgatacttcaatttgtgatccaatcttccgtgccgttcgtccagccaatcgtccaaaggttgattggaagaccgccaatgatcaagattatattaaagattccagcagtcgatcattaaacgcttcctactcaagtatttctggaaatggtaatggcaatgctaatgctaatggtaatggtaataatactactgaaactggtaacgttagagaattaaatgaggataatattttcgaagttatggaattagaattgaaaaaggttcttcaatacggtgaaaatgatgaaattgatccttatcaatccttatctgaattaggtattgattccattatgatgatggaattacgtaccattttaaagaatgttacaggaattaatattcctttggtagtattctccactcaaaatatttgtctttaccgtcttgtagaatatgtcaagaccaagttagtgaaggaaaaggaagaagctgctaagagtaaggcaaccgtaattactgaggaggaaaagcaagtgaaagccgctgaagagaagaaggctaaggaagaagaagctaaacttattaaggatgatcaaattgatcaatggattgttatggttccgggttgtgaacagataagtgatccattaaacattttcatcttctt

SEQ ID NO: 26298 - DNA, 6420 bp, Neocallimastix californiae
  POLYKETIDE SYNTHASE-RELATED
agctgttccagaaaaatttgaagattttaacagtaaagttaagttttctgatttagctattgatcgttctaaatatgaagatattgaaattgctgtcagtaaggaaattggtcgtcgttgctatatttctccttatttagatagaagtacaccagaagttttagaacaatttattggctatgctaaatatattaatagtaatcttccaaagaagttagattcaccaagatatatggttccaattgctgttgttggtatgggtcttcgtttaccaggtggtattaatactccttctaaatattggaatgctttagttaatggtaaggattgtatttcaccaactcctgctaaccgtcatcttcaccaatatttaaggccattttgcccaccaaatgaattaggcccatttgatcactatattcatcgtgctggttattatgatgttactccagatgctgccccaatttctgattttgatccaactttctttaatatttctccattagaagctaaattcactgaaccaaaattccgttggatctatgaaactgtttatgaagctttccaagatgcttgtataaatgtttctgaattaaatggaactcgtacttctgtttttactactgttggttctactgctgattatattgctttaactaaggcttttactaaagttgaatcaatgactagtcaaactatgcatggttctgctgcttctagttgtgctggtcgtatttccttcaactatggttttattggtccatctgatactattgatactgcttgttctagtggtttaaatgattgtcacaatgcttgtaaatcactttctatgggtgattctgatgtagctgttgtttctgctgttcaccaacaatttgtatctactcaattccatgttatttctgttgctcatatggcttcacaaattggtcgttgtgctacttttgatgctgaagctgatggttatgctcctggtgaaggttgtattagtattattcttaaacgtttagatgatgctgtaactgatcatgatcatatttatggtgttattactggtattactacttcacaatctggtattagaccatctatttcttctccagcggttggtccacaagttgagaatattcaaaaagctttacaaattgctaatgtttctccagctgatgttgattatgttgaagctcatggtactggtacccaagttggtgatgctattgaaactgaaactttaaacatagcctttggtggtactcacaatgctaagaagccattaattgtaggtagtgtaaagactaacataggtcacactgaagaagtttctggtttagctggtttatgtaaggttcttttatctatgtctcatcgtactattccaccacatcttcacttaaagaatttaaatccacgtattgatacctccgttattccaatgaccattccacaaaagaaatgtatttggaagagtccacgtggaaagaagagagttggtgttgtttcttcttttggtttacaaggtagtgttgctaatgctgtaattgaagaatttaaacttccaaagaatactgatagacgtttagatgaaggctatgatctttctatgtaccatattttaactgttagtgctaagaataagaatgctctcattcaacaagttgaagattacatcagtctttttgaatctatgaatgaagatgatagtattgctgatatttgttattccagtaacattggtcgtcaacactttggttaccgttactctgcctatggtcgtaatgcttctgaaattattgaatctttaactgatattttacaacgtgtatctaatgttcgtcgttatcttcaaaaatcaactgcttttgcttttactggtcaaggtgttgctaaggttggtatgggtaagcacttctaccaaactcaaccagttttccgtgaagctatggacagatgtgatgctgttactcgtcgtcttcttggcgtttccattgttgaggttttatataatgtttcaaacattccaaatggtactgaagaaggtgaaaaggctctcaagaagtcctctgttgcccaaccagctttattcgcttatgaatatgctatgagtcaattatggattagttggggaattaaaccatctatggttcttggtcattcacttggtgaaattgttgccactaccattgctggtggtattgactttgaattagctatggaattcattgttgaaagagcttcatgtatggaaaagtatggtattaagccaggtgctatggtttctatcttcactactgaagatgttgtcaaagaagctattgaagaatttgaatttgaaaatgtttccattgctgctattaatggtacaactcaaattgttatttctggtaatgcagatgaagtaaaagaattagaggaatactttattgaacaggatattaaggctaaacaattaaatgttactgaagctttccactctgctttaatggatccagctattgaaaagttatacgaatggattgatagtaagccagatgaaaaattccgtcaaccattaaaatatggtcttatttctaatgttactggtaagcttattccagctggtgaacgtcttccaaagaactactggggtgagcatgctagaaatgctgttcaatttgttaaggctgttgaaaccttattagccaatagtgaaactttattaaatgttattgaagttggtccagcttccgttttaactaacatgagttctcgtattttacgtgaaaagaaggttgataagtttgctgctccattctttgttgcttctgctcttccacgtgaaccacaagaagaaaaggccttatttgaagctgttagtaaggtttacaatgttggtatggatattaactggagagtcttccatacacgtgaagacatttacactcatgttcgtccaactcttaagaaagttactcttccactctatccattccaacgttcccgttactgggctggtccagataccacaaagtatgatattccatattgtactggtgttgacactcgtgaattagcaaataatattgaaaaggctggttatgttatcgatggtgataatgattccaatgaagtaaaacaagataatgataaccttgacattgctattagtgaaggctctaagaactggaaccgttatgaaactccaacggttattgatcttgatcacttagaaggaagtaaggttgttaaatctgctgaagaatctagctgcattattagtgtgccattaagttcaccatacattcattacttaagaaagagtcatgttattaatggaaagggattcagtccagcgacttcatttattgactttgtcttctacggtttaaagtttgcttatccaaatgaccaatttaagattaatgaatatttcattaccaatggtccattaagtcttagttatgaccatgatgttgtttacattatggtaaagaaaggtgaagaaattactatttactctcaaacttatggtggacaacaagaaatgagaggttctgttatagtttccgttgctaattctattgatagtgaaaaagccacagatgaactcggctttgatgttaagaaggattacgttgaaaagtacttaagtggtccaggagctaaggatagttcaaattacggtgaaggtaaggaattatacgaagaaatggataagagtcttgtttacggtagcttcttcagatctgttcaatccttctattcaggtaaggaacaagatggaacagaattccttatcagtcatattaagcacaacgttaagcaagttgaagaatcacttgttaattctggtgcttctcaagttggtattttagatgctgctattcattgtatgagtggtgatggtattgttgctaagaagaatggtgttgaaggatctaaggatagtttccttcctacttcatttgaaggtattattaagtacaaggaaattccaaatgaagtttatgttcttcatcgtgttaagagtgttaatgaaacttcgaagtttactcaatactgggtctttgatgttgatggaaaacttgtcttctctactgataacttccaagttaagaagtttgatatctctaaattaagtggcaaccgtgaatttagattgagtttcactgaatgggaagaactcccagtaaaacgagttgttaatgaaaacgttcacgttattgttttaaaggataagaagggttatgctgatgctttcattaaggcctttaaagatcgtaatattccaggatatattgttggagttgatcttccattatccgaagaaccaaatgctgcctttgcacatatttatccaaccattaaggctaagcgtactgctgaaggtgttcttgctctctataacttctctctcttagatgctgaagaatacaatggtaaggaaacagctgaggaattagtagcaaagtacaaagatctctacacccaatgcattgaatataccaaggctttcattcgtacctctgatgaaatgaaatttaagaaggatatacaattcgttaccatgggtgcctcaaaaattaacactgctgaatcttctgttggtccaatcgtttcagttgcaagaggtattttaaagaatcttaatcatgaaatgttagatcttcatggttgtttattcgatcttgaagtcggtacttcagttgatgttgctgctaactattgtcttgatgaacttcttggaggtgttgaccgttacgatatgccagtcaatgtttcctacagaaatggtaagcgtatgactccagttcttactgccagtgataatagctatgaaagatgtgaaagagaagaacttgttggtaatattcttattactggtggtttaggtgatgtaagtatggatgtcgttaattctctcctagctgacaaggacagtaaattggaacacattttccttctcggtagatccagtaagactaacagtagagttattgaaaagttagctcgtattgaaaaggtaaggaaagatcatgataaaaatattcaaattgaatattattcttgtgatatttctgatgaatcctctcttgctgaagtattcaatgatattcgtaaacgtcaaggcttacaaattactggtattttccatactgctggtgtcaacagtgatgccaacttcttaagccaatcctatgaaaaattagttgaaattgctccttcaaagattattggtactcataatattatgaaactttctgaagaatttaaggatgaacttaagtttgttgtctttgtttcatccctttctgctgttagtggtaacggtggtcaaactaactatactgctgctaatatgttcattgatgcgcttgctagatattataatgaccacggaagaactaatgtcatcgccatcgaactcggtggttggaagggagctggtagtagtgatcaattagttaatgattttatggtcattacttcagaagctggttttaatatgttcaagattgtttttactgccaattcaagattaaatgatagagtttataccgttattccagaaagaagttatgataaatgtgatgaatattacttccatgattatctctatattaaatatcgtccaagggatcgtccaagacaagatcttaccactattactcgtgaaggtgcctacgaccaaggtgaattagatgctaagaagaaatctgttactaaagataatattccagaaattttaaaggaggaagttcgtagaatgttaatgtataatgaaaatgatgaattagatatcttccaacctctctctgaattaggtattgattctattatgatgatggaacttcgtcaaattattaaggctgtaactaatattactgttccactttctattattaccacgccaaacttaacactctctaagatctttgaatatcttaagggtaagatgaatggtaatagtggtaatgaaaagtcgcaagaaaaatctgaaattaatgaaaaaccaaagactagtgttgctgctaagagagaagctcttagagctaagaaagctcaaagaaaggctgctgctgctgctattgattttgataatttaaatgattatggtgattggattgttcgtttagatactaataaggatactactaattctttcttccttatcccagctgctggtagttccattaatatgtataatagttggagtaagtatatgaataagtctgctttattcgctattagttatccaggtcacttggcccgtatagatgaaactccaattgatgactttaaagtattggttaagtctattggtgaagaaattttaaataatattaagaatggtaaaatttcaaaggataaaccaatttacttctttggtcattccttaggtgccttagtttcctatgaaacagttttatatcttcaaaa

SEQ ID NO: 26299 - DNA, 2661 bp, Neocallimastix californiae
  POLYKETIDE SYNTHASE-RELATED
tattattggtattggttgtcatttcccagaaggtatagagtcaaaggaagctttctggaaaatgttagaagatgctcgttgtatcacaaaggatatacccaaggatcgatgggataaaaatgaatggtattctaaggaacctattcaaggtacaattcaaactaaacgtggagccttcctaaaaaacccatatcttttcgataataagtatttctatatctctatgccggaagctaaagaaatgtcaccggaacaacgttggcttttagagttaactgtagaaaccttagaagatgcaaacattaaacctgaagctgtccgaggatcacgtacgggtgtcttcattggatcttctggttgtgattatttagccactcaaatttctcatgccaatgatattaattctcattctcctactggatttgaactttctattttagctaaccgtttatcctatgtttttgatttacaaggaccctccattagttgtaataccgcttgttcttctgcattttctgctttaaatatcggtttaaatgctatgattacggatgattgtgaaatggctctcgttgctggttctaattttatgaattgtccaggtggatttgtggccttctctcaacttcgtgtcgtttctcctgacggttcctgtaaaccttttgatgaaaaggctaacggttatgccagattagaaggagctggtatggtattaattaaaccctatgaaaaggccgttcgtgatggtgataaaatttattgtgctatcgttggttgtggtagtaatgaggatggtcgttctccctccctgactatgccatcctatgaagcccaatataagcttttaagtcatgtttgtgaaaaatcaggcatacttccatcagaaattgattatgtggaggcccatggtactggtactaaagtaggagatccaattgaatcccatgccattggagatgcctatggtcgtagtaaaggggttcgtggaccaaatgatccccccgtcctcgtaagttcagtcaagggtaacacaggccatggtgaaaattcgagtggtattgttagtatcataaagacctcattgatgctccataaacgtaaattagtacccaccgttgcttatcatcatatgaaccctgccattgatgctgaaaaattaggaattaaggtatgtgaaactttagaggattggaaaacgcctcatacccttcatgctgctgtcaattcttttggttttgggggtgccaatacaaatacgattttggaagaggtaaaacatcttcatcctcaagatatacaacttgccattaccccaggaaaaccattagtagctaaaatttccggttataatgaaaaattagtaatacagcaattaaaggagtggcgtaaggttcccaaagaaactcttttacctcaactttacctttctaatacctgtagagaagatagtcattatcgtatttcttttattttagaagatcctgacaagttttatgactatgtggatcttaccttgaaaggtcgtagtcatgttaatgttattaagcatagtaataaaatttccgctaaaccaaagttagccttcactttttcaggacagggtactcaatatcctgatatgggtcgacaactgtatcattctaacccttattttgctaatattattgactattgtaacgaaatcgttctttccatctccaaaaaagatttattaaaggaaaccggtttattcggtgatttgccagtaaatgaagaaaacttaatggatcctcaatattccttcttagcgatcggtattattcaattggctcttgtagaattttggaaggcctatggtgtagaaccttcattggtctttggtcatagtatgggtgaagtagctgctgcatatgctgcgggtattttaactttagaagatgccattctcctactgtatcattatggtcttatcagtcaaaatttggaggaaaataatgagaagagtggattaattgctttaggttgtggcgtagatgaagctaaaactgaatatataaaggataggaagaaggtctatattgcttccattaatagttacaaggatgttacgcttggtggtgatctcaaccaattggaagagatcatggatcaagcaaaacaaaaaaatgtcttcaccgttatgctaaaggtcaataaggctttccataccccattcattctttcagctaaggagaaattccttaaaggtattgaaggtattcatttaagagttcagccaccaaagattccattcatctcttctactcatggtaatgaatatcaaggtccatttgatgccaactattggtggtccaatattattaatccagtgaactttagtcaagcagtaaaaattgctcataccaaggttgataaggtcttagaaattagtagtacgccagttttaggtatctatataagtagtgtcttccaacccgatagtatcttctataccctctcacgaaagctaaaggatcataatagtttatgtagaaatattgcaaatatgtatgctaagaaatgttttgatcaattcaattggcgacaatattggattgactttatggacggtgtagatggcgagacgttggataagattcgtagtattgattacccaatgccaaaacatgcttgggatcatcg

SEQ ID NO: 26300 - DNA, 1857 bp, Neocallimastix californiae
  POLYKETIDE SYNTHASE-RELATED
tggtattgattccctatcggttatcaagttaaccaacgtcttgtcaagaaaattcaataaaaagtattctcctgctattctttttacctatggtacgacggcttctcttgccaaatatttaaaaggttatgaaaatattagctatcttccctctcaagaaaaagaccatggagcctccagtaataaaaagattgcaatcattggtatggcttttcgtttacctggagctattagtaattctaaatcattatggatggctttagctaaaagtagggattgcatcttacctccagtgaaaactagagatttacatcatggctatgtgaataagccagccaatcaattaggccccaaggaacactaccttgctcgtgtgggttgttacgatgttcgtcctaacgtggctaaaccttcagaattcgatgcagacttctttaactgttcaccggaagaagctactgctcttgatccaagacatcgttggatcttagaaacgagttgggaagctttagaaaatgctggtattgtaccaagctcgcttaaaaataccatcactggagtctttgtcggtatgaacaatgatcatgaacatgaagatctattaaagaaatgtggtaaagttccaccgttagccgctcatgccaccgctcaaagtagtattgccggtcgtctcagctatttctatgaactctttggtccttcctacaccatcgataccgcctgttctacaggttcctctgcccttcattctgcttgtcagtctatgcaatgtggggactgtgatctttctatcgtttctggcgtaaagtatatgtattccagtgatgaattccataagacttgtgcggctcgtatgacttcgccgaatagtcgttgtgctacctttgacgccagtgccgatggtttcgctcaaagtgaaggttgtgtgacctttgttttaaaacgtcttgaggatgccattcgtgataaggataacatcttatcggttatcctgggttccagtagtggtcaaagtggtttaagacaatccattagtgctccttcctcggaaggtcaaagaattacgattcagagagccatgaaggtcgccggtatcactccagatcaagtctcctatgtagaggctcatggtacgggtacccccttaggggatgccatcgaggttcatgcgctcaatcaagtctacgccggtagtcacacggaagaaaatccattagttgttggtagtattaaatctaatattggtcatacctgtgaagctgctggtttagcaggtatcgctaaggttattgtggccatgaagcataatactattccaaagaatattcatttcaatgaacttaatccggagattgacctcagcgtgattccaatgaaaattccaaccaagaatttaccatggaattcttctgaggaaggaaaacctttaattgctcaagtatcctcctttggattacaaggtagtatcattgttaccttccttgaacaatatcttcctcccaaggaggaggaggaggagaagaagaaagaaaaggttcttacaggagagagtagtggcgctatcactatcgcttccacgaaatccgttaagaaaaccagtaatgtggaaggagaaggagaaggtaaggatcgtcacttcttaactatcagcaccaagacctatgccgcccttctagacttgtacgataattacctcaatatcattgaaaatatgaatgaggatgaagacatccgtgatctatgctatacctctaatgttggtcgtcaacactttgcctacagattaattgctaatggtcgaaacgtgtcagaacttagtgacagtttagaagaagaaatgtcaaaattggaagaaaa

SEQ ID NO: 26301 - DNA, 6852 bp, Neocallimastix californiae
  POLYKETIDE SYNTHASE-RELATED
tgttattggtgttggttgtcgtttcccaggtaatattaaatctaaggaagatttctgggaaatgcttacttcaggtcgttgtcttacttcagaaataccaaatgatcgatggaatactgcggaatggtataacaaggaaccaaagagaggtactatgcaaaccacaagaggtgcttttatggaagatgcattctattttgataataaatacttctctatttctcaaaatgaagctaaagaaatgtctcctgaacaacgttggttaatggaattagcagttgaaacctttgaagatgctaacatcaatccaaagaaattaaagggttcaagaactggtgtatttgtcggctcttctggtatggactttgtttcagcccaaatttctcatgctaatgatttaactcaacattccgctactggtctagaactctcaattcttgctaatcgtatttcttacttctttgatttgaatggtccatccatttgtactaatactgcttgctcagcttcaatgaccgccttaaatcttgctattaattcaatgattactgatgattgcgatgctgcactcgttgctggaactaatttattatttactccaggtagttatgttgcttattctcaacttcgtgttgtttccactgatggttcatgtaagccattcgataagaatgctgatggttattcacgtattgaaggtgctggtatgattttaattaagccatatgaaaaagctgttaaggatggtgataagatttactgtgctattttaggtagtggtactaatgaagatggtcatactccatcattaactatgccatcttacagttctcaatgcaagttattaacacatgtttgcgaaaaatttgatattgatccagcttcaattgattatgttgaagctcatggtacaggtactgcagttggtgatccaattgaagctcgttccattggttacgcctatggtcgtagagttcgtgaaggaaagcaaattaaaactactcgtccaggtgaaactgaagaaattttagatcaacctactttcccattacttattggttcaagtaagggtaatactggtcatggtgaatattcaagtggtattattgggatgattaaggctatcttaatgttataccaccgtactatggtgccaaccattgctcataaggaaatgaacccagcaattgatgctgaaggtttaggaattaaggtagctactaaattggaaccatggaccactccacatactttacgtattgctgttaattcttttggttttggtggttccaatggtaatgctattttcgaagaagttgttaatgaaaaacctgaagattttagtatgaaaattaaagatccaaagaatcctgttgttgcgactttctccgcctatgatgaaaagacccttcaaaatcttttaaagaagtggagtactgaagttccaaatgaaactcttttacaagaacttttcgttatctctcaatgtcatgaatcagaaagtatgcgttctgctatgatatttagctccgtagatgaagctaaggctttaattgaagaaatgagaaatggcaatgttgaaaagtttaagagacatgagaaaatttacatgaagcgtgttaagattaatgaaaagccaggcattaactttgctttttctggtcaaggttctcaatttataaatatgggtagacgtatgtatcaagtaaatggtcttttcaagagaattgtagactattgtgctgccgttcttgttacctacaatggtggtgaagatatttttgaaaagtaccatattttcaagggtgatgtttctcaaattagtgaagctgatctttctcttccacaatactctattcttgctattggtgttgctcaaattgctcttactgaaatttggaaggctatgggtgttactccagaagctgtttttggtcacagcatgggtgaagttgctgctgcctatgctgctggtattcttacacttgaagatgctatcttattattatacatgcgtggacatattcttgctcaattagatggtaccggaaaaggtatgctagctcttggatgttccgttgagcaagctcaatacttcatgaataataagccaaatgttttcatttctgctgttaatagtgctaactctatcactttagccggtgatattagccaaattaatgctatcgctcaagaagctaaggctcaaaacctcttcgctgttgttttaaaggttaagcaagctttccattctccatatgttgaaggtgctgaacaagcctttaaggaaagcattagaggtattagtgaacgtacttccgctccaaagtgtaaatttatttctgcatgctttggtcaagaatatgaaggtccatttgatgaaaactactggtgggctaacattcgaaatccagtaagtttctatgctgctgctagtattggtactcaattctctaaacgtgtattggaaattggtgctcacccagttcttagtgtgtatcttaaagaaatttatggtaaagaatatgtttatcaatcattatccagaaagatggatgatgttgatagcatgtgtcgtacaactgctgccttattcattgataatgccgttgaattcatggattacactcaaatttgggaaggcaaggttgatcttcaacgtgttaaaactggtgacgttgtaccattaaagaaattacgttctattaacttctctattccaaaacatgtctggaaccgtaaggccattagaaaggaatacactgatcgttttggtactgattctaatcatgaaatttataccactcgtgaatttgttcttaaggaaatgggtctcagtgaagatgatcttaagcttcttaagaatattaaatctggtaaggttgcaccagctgctggagctgctaatgaaacctcatttactgttcaatccccagtttctattgctaagccaaagccaaagccaaaggttgttccacaacttccaaaggctacctttattccaactaatgctaatgttatctatagttctggtaatcaatggaactttgaaaatcatagatatcttcaagatcatgtcgtcaataaaaaaattgttcttccagctgctggctccgttagtcgtgctttcagtggtttcgctactgctcatccattaaaggttgctcaaagagccatcatttctcttgaggatttgaagtttgatcgtatgggtatctttgataaaactattgattttaatactgccactggtccaatgccaattacttatgaagaggaaagaagtaaccaaacctataaaattatctttaatgaggatgttgaagtttcttcaggtaaatttaataacaatgatgaaactgaaaccttaaagaatattccagctgtagattacttcattaatcaatgttcatcgatcgctggtggtcaaggtgttactccagctatgttttataatcgtactcaagaaattggtttagattatggagaggaattccgtttatataaggccattcgttcaggaaagaatgttgcttatggtaaattaactgtaagtaaagaacatcaaaagatggtttgtcaccctgccgttttggataattgtattcaaatcgtttttgcctctggtgttgctgctggtgattgtcaagctcttccagtaggtatgaagaaggttgttttaagtcaaggtggtcatttcccagaaggtactcttattgttgctactgaattagttaaacaagatattaaggaatgcgtctccaatgtttatatctatgatgaaaataaaaatatctttggttatgttgaaggtttgacaatgtctttccgtcgtagtagagctgaaaaggctattgattggattcatgtcttaggttttgaagaaaaggctccaacagccaatgaatacttaccagtcgattgtcgtaacgttattgtcatgtgtactgaaactcaacaagatgaagcaaatgcatttgccactcatattggtagtgttgttgccggtttacaaaacatttgggtcttaccaggtaactatattgaaaatatccaacaaatggttgaaaataagatgattaaaccaaaagaaacatttattattgatgctagcttcattgatagtcctgaaattgatcgtgcattcatgattcttaagactgtggttaactatgaaattccaaccttatttgctgcttctaaatacataaaggatgaatcagctcaatctcatgctgtagctaccagtaaggcagttattggtatggttcgtgctgctcgtgctgaatgtaaggttccattattcactgctcataccgataaattcgaggatttatatttggctgctttacgtagtggtttaacaatggatgatccagaagttgaaattattgatggtaaggttcaatgtgttagatttataaagcttgataaggaacccgtagttaaatcttctaatattaagttagaaagaagtgccaatggtcaaattggtcaaatgaagtatagtgaatgcattggtcttccggcctacactgatgatgaagtggtcattaaggttaagggtgtatccatgcaattcaaagatattatgactgctatggatgctctcattggtttcgatagctatgaaccgggtatggaatgcattggtcgtgttgttgccattggtaagaatgtcgctagcaacccaagaaatcaattacaaattggtgatccagtcattgcattctctcacaaatatggtcatctcttacgtacgtatggtgttgttgatccactctctcttcaaaaaattccagaaagtatgtataaggttgaatatgctggtatctttattgttttcattactgcttattacagtttacatgttcgtgctggtggtattaaacccggccaaactattttaattcacgccgctgctggaggtgtaggtcaagctgccgtgaagttatgtcaactctggggtgctaatattattgccagtgcttctgcttcgaagcaacaattccttcgtgatacttatggtcttgagcatgtaaccaactccagagatccagaagaattctaccgtgatgtgatgaagtggactgatggtaagggcgttgactttgtgttaaactctctttccggaaagagtcttaaaatgggtattaagtgtttgaagaatggtggtaagtttgttgaaattggaaagactgatattttaaatgacagcaagttaggtctacattgtcttcttaataatatctcctttgtctcatcacatattgatcttctcaacaatcaacaaatgaattattacaagaatatcttgtttgaaatgtttagtactggtaagcttactccaattcctgccaagatcttcccaggtaataagtacaaggaagccttcttctatcttgccagtggtagaaatattggtaaaacttgtattgaattcgaagataacatgagctatgaatgtactccagtcaccttaatagatccaaatttaacctatttaattactggtgcttttggtggtgtcggtttaagagttgttctttggctagttagccgtggtgccaagaacattttattaaccactagtagttctgttgaaaaacaatatgaacaaccaattattagatctttattggaaaagggtattaatgtaatgattaagacctgtgatattactgatttgactagtgttcaacaattattccaacaaactactccaagaattgctggtgtcttccatttagcaaatcgctttgctccaggtttaattagtacttccgatcttgctttgcttcgtaagggcttcagtgctaaggctgaaggtgcatggaatttacacttggttactcttcaaaaggctcatcaagttcaattgtttgttgtcttttcttccattcttgatgttttaggtaatcgtggtcaaactgcttatggtgctgctaatgctttcttaagttctattgttgatcatcgtagagaaaaaggtctctctggtaattgtattgctcttccagctatgcgtggttctggttacttagcaaaatggaatcaaacaaaacaatctaaggactttgaacaattaattgctctcttagatactgatgaattagttaatgtaatggatggcttaattcgttatgatcttccagccaatatatatatggctaaaaattgggcaaatatgtcctatgatgctacctttgttgctccagttactcgtagtatttctcatttacgtggtgttaatccagttccagtagtcaccttcccaactgaaaagaagcttgatcttccatctttaattagaaattgtggtggtcattatattgctgaaccaacacatattccaagatcaagtgccactactacttcttctgtacgttcctttactccagttgctgtgaagagctttagtccagttcctgttagtccagttcctgtttccgttcgtacatttactcaagattctgttgctccagctgttcaagttagatctttccaaccaacatcacttgcaactccagttgctgttcaagctagatatactccagctccagctccagttccagttccagcttcagttccagttgctgatgctaagccaatcagtagtcttaataagaataaattaaccaaggatattactgataaattacaaagtatgttaggattaattgatgaagaaattgatgttactattccacttcgtgtctatggtttagattctttaacagctatggaattaaccaaatggattgaaagtgaaatgaatattgaattcagtcaaagtcaattattaggtgatgatattactactgaagatttaattaatattattatggatgg

SEQ ID NO: 26302 - DNA, 1767 bp, Neocallimastix californiae
  POLYKETIDE SYNTHASE-RELATED
cgattctcttgctattattaaattaaccaatattttatcaagaaagttcaatgagagatactctccagctattctttttaactatggtaccaccagtcttcttgctcaatatataacgggtcatgacagtgataacattaacattaataaaactatgaataatatacaaatgccaaaggaaagtaattccaaaacttctgataaaatcgccattattggtatggcattacgtttaccaggtactatcaataattctaaatcattatggatgtcattagccaaaggaagagattgtgttttgccaccagttaaaactagagatttacatcatggttatgtcaacaaatcatttaatgagttaggtccagatgaacactatcttcctcgaattggatgttatgatactcgtagtaatgctgctaaaccttcagaattcgatgcctcgttctttaactgtactgctgaagaagctatctcattagatcctagacatcgttggatcttagaaacaagttgggaggcattagaaaatgcaggtattgctccaaattctttagaaaatactttaaccggtgtctatgtcggtattaataatgaacatgaacatgaagatctattaaaggaatgtggtatcgttccacctgttgcttcccataccttaaatcaaagtagtattgcgggacgtttaagctatttctataaactttttggtccatctttcactatcgatacggcctgctctactggttcttctgcacttcatactgcttgtagagctatgcaatatggtgaatgtgatctatctattgttactggtgtaaaatacatgtattcctccaaggaattccataaaacatgttctgcccatatgacttctccaaacggtcgttgtgctacgtttgatgaaagtgcagatggatttgctcagagtgaaggttgtgttacttttattttaaaacgtcttgatgatgctattcgtgataacgacaatattttaactgttattcttagttctgttagtggtcaaagtggtttcagacaatccattagtgctccttcctatgaaggacaagctattaatattgaaagggcaatgaaaattgctggaatcaagccagaacaagtttcttacgttgaagctcacggtacaggtaccccattaggtgatgctattgaaattcatgctcttaataaagtttatggtggtagtcatacggaagaaaatcctttaattgtcggaagtattaaatcaaacattggccatacctgtgaagctgctggtttagccggtattgcaaaggtcatcgtttccatgaaacataatcttattccaaagaatattcatttcaataaacttaacccagaaattgatatttcagctattccaatgaagataccaacaaaacatataccatggacttctcctaacgaggatgaaccacttattgctcaagtttcttcctttggtttacagggtagtattatagtcaccttccttcaacaatatatccctaaaaaggaagaaaaagtttatgaaacaaatgaaaatcatattttaactattagtgcaaagacttatttagctttatatgatttatatgaaagttatattaacattttagaaaatatgaatgatgatgatgacattagtaatttatgctatacctcaaatattggtcgtcaacatttcaaatatagattagtggcaagtggaagaaatccatttgaactttgtaacaatttagaggaagaaatggaaaaactaca

SEQ ID NO: 26303 - DNA, 6528 bp, Neocallimastix californiae
  POLYKETIDE SYNTHASE-RELATED
agatcttttagaagaagctatggatatattattacgtgttatagtaaatgaatttccccaaattttaaaagtttcaccaccgaaaattatattagatagtaagaatccgactgaagaatattcaatgttaaaggacacacctaatagtgatcgtcttaatcttccgttaccaaaaatagctattattggtgttggttgtcgtttaccaggtgatattttaaccaaagatgatttttggaatatgttagtaacaaaacgtgttgtcacaactgaaattccagctgatcgttgggatcgtgatgaatggtatagtgatgagcctattccaggtactattcagacgaaacatggtggtttccttactaatgcttatgattttgataataaatatttttctatttctcaagctgaagctcttgaaattactccagaacaacgttggttatgtgaacttgctgttgaaactatggaagatgctaatattcgcccagaagaattaaaaggtagtcaaacaggtgtttttgttggttctgctggtattgattttggtggtaaccaattagttaatacattacaaatgtccgctcataccatgacaggtttagaaccatctatcttttctaatcgtatttcttacattttcgatttacatggtccttccattacaagtaatactgcatgctctgcttcaatgtcctctttatctatggcttgcaatgctattgctgttggtgattgtgataaggcttttgttgctggttccaatttcttaccatctccaggtggctatgttgctttctctcaacttagagtagtttctaagactggttcttgtaaaccatttgatgaaaaagcggatggttatgctagacttgaaggtgcttgtatgcttttaattaaagattatgaaaaggctgtaagagataatgataagatttatgcttgtattattggtagtggtactaatgaagatggtcgtacattatctataactatgccatcctcagatgctcaatgtactttaatgaagtgggtttgtgaaaaaagtaatatcaaggcagatactattgattatgttgaagctcatggtaccggtacaccaactggtgatccaattgaagccagatctattggtaatgcctttggtaaggctgttcgtgctccaggtagtaagccacttccagttggtactgttaaaggtaacgttggccatggtgaatttttaagtggtgcaattggtctcttgaaaacttcgttaatgcttttcaataaacaattagttccaacagcagcttttgaaaaattaaatccaaaaatagatgtcagtggtttaggtattcgtgttgcagataaaaatgaacctatggttaaacttaatggtaaagaaaataccccattgcgtgctgctgttaattcctttggttttggcggtgctaatgccaatgctattttagaatctgttgaaaaaatcgatgtagaaactgtagatattgttaagaaagaaaatacattaccattaatggtttctttcactggtttcagtgcgaaggctttaattgctacaattaaggaatatttagaattacctgttgaacaacttttaccaaagctttatttaatgactactaccagacaagttcatactcatcgtgtaactttcttattagataatgccaatgaattttatgagttagctagtgcttttatcgaaaacagacctcatccgaaggtaattcataatcttgttaaggcttctttcaaacaaggtataacttttgtatttagaggaatgagccaattaaattcaaatattggctatagtttataccaatataaccaaaaatttgccgaaattgttgattactgtgataaggtacttgaaaaggtaagtggtggcgtttgctcacttaagagagaatttggtttattccaatcagaaaatttgaatttcctttctcttcaaaatccaaagatgtcaattattggtaatggcatgatacaattggctttgggtcatctattaaagagctatggtattaaaccatcttctgttgttggttacaattctggtgaaatcgctgctgcttatacagcaggtattattagtttagaggatgctatcttagttttatatcaatacagtactattttagaaaaagttccaaacaaaaagaatattttcactcttgaacttggatgttcagctggtcaagctcaaactaatattataaatcaattatccagtactatctatatttcaggtaataatgctgataatatttgtacactctgtggtagcagagaaagtcttaatcaagctgtttcaatcgcacagcaaaatggtattccagttttatctaatttaattccaggttcttgtggtatttgtacaccatatctaaatgattttaaggatgaattctttgcttcattaaagggtattggtaataattgcaagaccccagttattaaatttatttctacgactttgggacaaccatttaatggaccattaaatgaatattattggtgggcaaatttatcaagtactgtaaactttagtcatgctctttctcttgcaatgaatgaacaacaaaagggtagtgggtacattttagatgttggtagtggttacgctaatgctgctctctttaccaattactttggtgctttcactacagcagataagatctttacaacttatgatactactggttctagttctaatgaagctcttacattattatatacaattgttcatctctttgaaagaaatgcaattcctttaccagcaatggataagatctgggaaaatagtgctgatgttgttggtgttgattctttcaaaaagatcagaagtgtcaactttattttaccaccacatgtatgggaacataagaaaataaagaaaatttataataaggaagtatttataagtttgaaaaagaatcaagaacttaatgaaagacaaaaagaacaaattaagttaactggaggtgttgctattgatcatgatgataaattaagtgttgaaattgaaaaattaaagaaagaaatcaatgatattactcaaaaagatgccaagaaggctcaagaagttgctaaagaaaatgctcaaagaatgaaggatatgaagaaacaatttgaacttgaaaaggaagaagaaattaaaaagaaggttgatgaagaaaagaaaactatattaaaggaagcgagaagattcataactagagaaatagaaaaggctaaaaatagtgccgcagaagcaataaaagccacaaaagcggcagaagcagcagaagacatttctcactcttttagaaataaaaatactttatctgctgtaaaggattctgattcaacgtctaagccaacagtcatatcatactccggtaatagtgaagcctggaattttgaaaatcataagtatttagttgatcacattgttggaaaggatgttgtatttcctgctgcaggcagtattagccgtgccatgtatggtttcaagcaaagtagaggcgaatacaatttcgataaagatagaaatattgtttttgaaaatcttgagttcttgcatttggcagttttcgaaaaatcagttcaagaacaattaaataagaaaggtccaattccaatttctcttgtggaagaaggcgatggtaaatacactattgttcaaaagaatggtaatcctgtaagtaagggtcaattctatgaagctcaattgactcaaagtaaggaagaaaattctaacttactaagtgatgtaccaacatttaatgaatttattaatagatgttctactaaggttggtggtaatggtgttacctctgaacaattatatcatagaacagatgaattaggccttaagtatggtccaaacttccgacttgttcaaaattgtagagctggtgataatgttggttatgctcgtattaaggtagatgaagaaaagtctaaacttatttgtcatccagcagttcttgatgcctgtttccattccatcattggtactggtattgctaatggggatcgtcaacctttaccaaataaaattagaagatttgttatgggtcgtggtggttacttcccacaaggtaccattatttgtgctgctgatattataaagcaagacttgaagaatgttattgtgaatatttacatttatgatgaagataagaagccaattgctaagattgaagaaatggatatgactatcagacaacttaacgttttacgtaaggaaagatggattaaatatatgggtgaagaagtattaacttcattgactcatgatcaattaccaattcaaaattgtactggtattttagttatcggagaaaaatcacaagaaaatgaaattaattattcattattaccacgtcttgctgccattcaaccacttatctatatgatattagatagttatgatgaaaaatttaaagctatgcttgatgctaatgttttggttccacaaactaccctcgtcattgatgtcagatatttagctaatccatcaattgattatgcttactcaacgatgaaacttttaattgaaaacaacttcaactttgtctatggtaatattgaacatggtgataagttaattttcaacgaaacctatgaaaatatggcatttggtaatagtattgctggattattgcaagtagctcgtgctgaatctaagaccaataaaatctattctattcaagctgaaaatttggaaaagtttacgcatggtttattacgtggtaatttaactgtcgaagatccagatatcagagtaaaggaagatttcagaattaccgctcaaagaattattaaagaaccagtcattccagaaattaagacaaagaattacactttggaacatagtaataccggtcaaattggtaaattaaagttccgtgaagtctttggtcttccagaatgtggacctgatgaagtaattataaaaattcatagtgttgcccttcaattcaaagatataatgagtgtaatgaataatttaccgggttacaacgtttatgaaccaggcatggaaagtaatggttatgttgttaagattggtgaaaatgcaaagaagcatattcaacttcaaattggtcaaccagtttttgcctttactcataagtatggccatatggtttcaacgtatggtaaagctcactacaaattagttaaaccaatgaacaccaatgatatgaatccagaatcttatagttctgttattgttctcggtactgtcttatatgcccttcgtgatcgtgctggcggtgttaaacgaggtcaaagcattttaattcactctggagctggtggtgttggtcaagcagctattaaattatgccaatattggggtgcaaagatatttgttagtacttcagctaaaaaagtccaatacttgaaggatatgtatggtttagaatacattactaattccagagattcgaagactttttataacgatattatgaaatggacaaataatgaaggtgttgactttgttttgaatgccctcgctggtgatggtattacatatggacttaagtgcttaaagaagggtggtcattttgttgaaattggaaagaagaatattatctttaatactccattaggcttaaaaagtttaatgaacaatattaatttctgttctgctcacattgatttacttgatgtagataagctttctagtttaatgaatgaatcctttgaacttctcaattctggtaagatcactccaattccggtaacattagtaccaatcaagcaatatctttcagccttctttaatatggcctccggaaataatgttggtaagacttgtcttgttatggatgatagctatgaaccaaattgtaaaccagtcaatcttgttaaggaaaataaagcatatttaatcactggagctttcggtggtgttggtttacgtgttgctgaatggcttcagttaagaggtgccaagaatattgttttaactacatctggtaatatagaaaagcgtaacagaaaccctattgtggaaactcttcgtagtaaaggtgtccatgtgacagttacccaatgtgacatttcaaatattcatgctgtccgtaagttattccaagaaacaacaccacaaattgctggtattttccatctagctaataaatttgctcctggattgattcaaagaacttcccttgaacaattccatgttgcttataatccaaaagcaagaggtgccttaaaccttcatttagttagtaaagattatccaatagatatgtttgttatgttttcttctgttcttgatcttttaggtaataagggccaagctgcttatggcgcagctaattccttccttggttccttagttgaacttcgtcgttcgcaaggtttatgtggttcatgcctttccttgccagcgatgaagggttccggttaccttgctcaattcaagcaagaaagacaagcaaatcaattcaagggattaatcacaatgttagattccgatgatttaccagaattattagatgatgtaattca

SEQ ID NO: 26304 - DNA, 2013 bp, Neocallimastix californiae
  POLYKETIDE SYNTHASE-RELATED
ggcagtgattggtatggctcttcgtttacctggtgccatcaataattctaaatcgttctggatgtctttagccaaaggtagagattgtgtcttggctccagtcaaggatagaaaattacaccttggttatgtggataaaccatctaatcttttaggagaaaatgaacataatattccaaaatgtggttgctacgattctcgttcaaatgcagctaaaccttctgaatttgatgcagaattcttcaactgtttacctgaagaagtcaatagtatggatccaagacaacgttgggtcttagaaacgagttgggaagctttcgaaaatgcaggtattgctccaaataccttagaaaataccaccactggtgttttcgtgggtgtaaatgatgatcatgactatcaagatttattgaaagaaaacggtatcgctcaacctatttcagcacattctactccaagtggtattgctggccgtctcagttacttctataaacttttcggaccttcctttactatcgatactgcttgttctacaggtgcttctgccctccactctgcttgtcgttccttacaatttggagattgtgacttatcagtggtttccggagttaaatatttatattctgcctctgaattccatagaaccagtgttgctcgtatgacctctcctcatggtcgttgtgccacgtttgataaggatgctgatggttttgcaccaggtgaaggttgtgttacgtttattttgaagcgtcttgaagatgctgttcgtgatggagataatattctttcagttatccttggtaccagtagtggtcaaagtggtttaagacaatcgattagtgcaccatcttctgatggtcaagtacttaacttgaagagagcacttaaatttgcaggtgttgatccatctgaagtttcttttgttgaagctcatggtactggtactccacttggtgatgccattgaagttgacgcccttaatcaagtttatggaggtagtcacaccgaagaaaatccattagtgattggtagtgtgaaaacaaacattggacatactaatgaagccgctggtttagctggtatggctaaggtcattttagccatgcaacataaatatattccaaagaatttacatttcaatacgcttaatccagaaattgatattcattccattccaattcaaattgctaccaaaaccatgccatgggaaacacaagataacaaaccacgtattgctcaagtatcttcctttggtttacaaggtagtattgttcatatcattcttcaagaatatattccagaaaatggaaaggaagaagatgttaagaagagtaaggatagtaaagaagatcatatcttaaccattagtgctaaaactccagcggctttgaatgaattatgtgaaagttatttgaacttccttgaaggtatggaagataatgaagaaaatattgaagatctctgttacacttcaaatgttggtcgtcaacatttcgattatagaatttcagcgattggtaagaatgctcatgaactctatgatgatcttgagaaaaaaatggaaatctttgatgatgatgaagataatagtgaagctatattcaaacaggttgcttccaaaagtaatggtatttctcaacatcttgaaatttattctgaaaatgctggtgatcttcaaattcctaaaaaggtctatgataccgttaaggagctcttatctactgaaaatagtttcaagaagacattcgaattctgtgactctgaaattcaaaagattgctgaaggcatttccttaaaacaaatgatagaagaagaaaagaatggaaaggaaagcgaactcaataattcattctttatcctttctttctattacagtttacatcaacttgtcgaatccataatgataaagaataacagtagtaagaagatttatggaggatttggatttggagaaataataagtttagttcttagtggaggattatctttcagttcagccatttccttaattca

SEQ ID NO: 26305 - DNA, 7125 bp, Neocallimastix californiae
  POLYKETIDE SYNTHASE-RELATED
tatattacaatcggtattaattcaacattatcctaacgtcattcatatgagtatgattccaaaggaaattcaaattgaaaatatgatggatcctacggaaacttcttcctccgttctagaagaacacgtcattgatagtgatccaaaggttctctatccaaaggaatatccaaaatttgctatcattggtacgggtattcgtttaccaggtgaaattaataataaggatgacttttggaaggtaatgaccgataaaaaggtgatcaccggtctcattccagaagatcgttgggatcgtgaagaatggtatagtaaggtcgaaaagccaggcaccatacaaacccttcatggaggtttcattgaaaatgctttcgatttcgataataaatattttggtatctctcaaaatgaagcgttggacgccactccagaacagagatggctatgtgaattaacggttgaaaccgttgaagatgccaatatggatatggatgattttaaaggaagtcatacgggggtctttgtgggtacctccggtatggattatggtagttatgtcttttctgttcctgaaaaaattactaaatatacgtacagtggtattgaaccttccatccatgctaatcgtgtctcgtatcttttcaatcttcatggtccatcgctttccactaataccgcttgttcctcttccatgaccgccttatccattgcttgtaattcgatggccgctggtgactgtgaaatggctttagttgccggtactaacttcttccaagccccagctaatggagtagcctattcgcaacttcgtgtcgtttcgaagaagggagcctgtcgtccatttgatattggtgctgatggttatgctcgtttagaaggtgccgccatggtcttgttgaagccatatgaaaaggccattaaggataataatcgtatttatgccactattttaagtaccgcttgtaatgaagatggtaagacctcatccttgacaaccccatcctccgaagcgcaatgtcaactgatgaaacgtgtgtacagtaagggccacattgatccttgtaccattgattttgtggaagcccatggtaccggtacctctgttggtgatcccattgaagctcgatccatcggtgaagcctatggtaaggtgaataaggccaatggacatcctttactacccgtaggctcagtgaaaggtaatgtgggtcatggtgaatatttgagtggtatcgttggattaattaagggtgccctcatcctccacaagaataccattgttccacagaccgcgtttgagacgttgaatccaaagattcattgtgatgaactgggtatccgtattgctgataaggtggaacctcttccaggtaaaggacgtcatagagccgccgtcaactcatttggttttggtggtgctaatgccaacgtaattttagaggaggagcctcaagtcgataaaaataatatttcagtgttgatgaagagaaataagaagggtgaaattattccatgtgcctatgttgcctttttctctgccagtaacttaagattgttgaaggaaaccttgaagaaatggaggactgtacccaaacaagaattattaccaatgctttatttgaatgcgaccactagaaatgttttaacccatcgactctttatctttacgaaggatgctgatgaattttacgacaccattcgtcaatttattgaagatgaagaggattccatttcgtcaggctaccgagccaccgaacaatttatgtatattgaaaccgccagtgatcgtaagaagggtgtgaccatggcctttgatgaaccattcttctccactacttccttccttagaaatgctaccttttatgatacctgtagagatttctattgtaataatagctactttgctgactgcattgattattgtgatcaggtattaaagatgataagtggacgttctcttcttgaagattatggtcttttccaatccgtaaaggaagaagaaaaggaaaaggaaaaggaaaagaaaaacaaattaagagaagatcttctcaaggatcctactactactcttttaattaatggtataattcaattaggattagtggcactctaccgttattatggcatttctccaaatgcagttattggttatggtgctggtgaaattgctgctgcctatgctgcagaaaagatagatttaaaatcggctgttcaaattctttatcattatggaagggtattatcgatggtgaagaaggatgataatctatccaaggtgtatagtatcttggtaggttgtcctgttggtaaattgagtcaggtgatactttccaagttaagtccaacggagaaggaattaatttcgatttccggagttccttctccaacgcaatgtgtattgaatggagaaatggaaatactaaagaagattatggagcaagcaaagactgaaaagattccaatacttggtagcctaatggattctttcgccatccacaccaaaaagatttctgaagcaatgaaggaagaactggtaaagcgtttaacgaacattaaatccaagccttcctccattgccatgttctcgaccaccaaattcagtaaagaaggaaagccatataccgacgcattagatggtcagtactggtggatgaatatgagaaatccagtgctctatgctcattccctctcccaaacggccaacttccttccaaccgatggtaaaaatattttagagattggtcttcactttgatcatttggtgttcaagtcatcctctttaggattttatcaaaaggacagaatttataactgtttccactatgaagaaaatagtagccgtgataacagtagcaaccttaaccttaaccgtaacagtaacagtaacagtactacggtcactgccactaattatgatatccgtttcaatcaatttattcgtttcctttgtacaatgtatggatataatgtttgtcagaaattaaagtttggccatctctgggaaacgatggtgaatgtggaaggtggtgatcgtaccttacaacagttgtccagtatgcattatgatcttccaacacgttgctggaatcataaatacttgagaaaactttacaaggccaagagaaatggtttaccgggggatgtcaacattgtgaagacaaaggatgttgtctatttagaaaagatggcattaacggcctcaagtaagaaattagaagaaaagatagaggctaaagcgaaggccactagtgcctcactaaaaaatgagggagaaaatatggaatccaaaatgatgataaaatctgccactatttctactcttagagacgaaaagaaagtaggaaaagataagaagcttgaagaaatatcaaagaaacaaaataattccactcccaatctttcaatgaataccggtaatagtaatagtaataataacactggtaccagcggccctgttgataccaaggatcgttcgggttcatccaaatcaattccaggaaaaactcaaatgatttcactcgtaccatataattatcaaaagactaaaaattctaccttgaatggtaattccgctgtttattcttcaaagaatttacaaaagtattcctccacttcctccttatcctccacttcctcctcctcctcctcttcttcttccacctctctaaagaatgaaaaaagtacatcaaaaccagcttcagtattagcagcaccaatttctattcctattccaattaaggtttcagcttcagaagtgaaagatcgtagtaccataaaggaggaaccgcttaaaaaatcggtgactaagatgccttttacggcaaagaaagaagaagcaattgaaaataaggaaaaagaagtcctgaatgaggttaaaaggaatgatgatatgatgacgaaggctacagaagaagatgaattttgggtatacgaaaataatcaatatttagtggatcataaggttaataatcaaattgttttcccagccgctggtagtgttagtcgtgccctctatggttatgaaagaagtcgtggtattatcgaatccgaatctatagttaccttaaatgatttagaatttgtaggacttaccgtatttcagaagaccgtcgaaagtcaattgaggagtaagggacttattcctatgaaattgtatgaagatgaggatcatcaatttattttgaaacagaatgatggttccgtgattagtaagggtaccttcccacctcttcattctcctaaggaatccgaagtattaagcaacttcccagaattttcagaagtaatcaagagttgttccacggtgaagggaggtgaaggtattcgtaaggaacaaatctatcaacgagccaataccattgagcttcaatatggacctcaattccaattgattcaacatggacgttctggtaaaaagtattcctatgccaagattgctgttcgtgaagatcatgcccaaatgatttgtcatcctgccgttctcgataactgtttccactccatcatatgtttaggccttggttgtggtaatcgtcaagtgcttccttacaagattaagcgtttagaaatgaagaatggaggtcgtttcaaggaaggtatccttacctgtgtcagtcaattgatatatcaagatttaagtcgggtgatggttaatctctttatctatgatgatgctggagaaccgttcatgaagattgatcatatggaatttttgattcgaaaattgaaacccattcgtccattggaatggtataatgttctctgtaccgaaaagttggaggaaaatttagaaaagagattccctctctcctgtcatcacgttgctgttctctgtgataaaaagcaggaagaggaagtcaatcgtcatcttgtaagcattctcagtacttttaatcatctttccgtctatttaatcaccgaaaatcatcaggagtccattcaagccatccttcaaagtggaagtgtaccgaaggaagatttcggcatggtagatgtgacgcttttagaggatgcctctcttcctacggccttccttaagattcaatactatgtgaaggaagggttaaactttgtgatgggaaatattcgattagatcatgtcaaggttagtgaagatatcgaaaacttattcacggcgtctaacggggttcccggtatgttgaaggctgcccgttctgaatccagaaagagtcaaatgttctcaattcaagccaataccgtcgaacaatttgccaagggacttttcgcgggctaccttagcattgaagagccagatgttatggtaaatgacagtggagagcttcaagcctaccgtttaattcatcaaacgaccattccgtccattcgttccaaaaatttcgtttctgagccaaaacttgttggtcatgttaatcgtatgatattccgtaagacctacggtattccagatcttcaaggtagtaatagtagtagtagtagtagtaatggtagtggtagtagtggtcgtgaaagggataaggaatgtgttattgtgaaggtgaaaacgatttctcttcagaataatgatgtccttcaaaattcgtatccggaacttgcagagattatgaagggttccagtgtgattgaatgtgttggtactattgtgaatgttggtagtaaggtaaagaaattcaagagaggcgatttcgtttttggaatcagtttctatggcgattacgttccatccacttatgttaagattccacaagatttagtctttgccgtagatagaaaggataccctgaaacagcaacaacttatttcttccgtttatgcctacacggtagccctctacctcttgaatgaaattcaagccaatgagtcggttcttcttaccactaatgctgtcgatttaatgcaagctctcgtagttattgctcaacagaaacaaatttcaatcgtgttagatgatcgctccaaaaaatacagtcgtagccctaatccaatcttttccaatcttttcaagagtcaacgaatgattcactccgacggagatcgtaatcaatgcgttcaacaggtcaaggccttcaccaataatcagggggttcactatgttattgatgccaatgtaaaatttgatcatgaagaggtattggaagcctgcttaagggaaggaggtgaatacattaaggtaggtaatcttgatcatcatgttaagaagagaacgacacataaggttgttcaaatgagtgccctcagtgtcaaacaaatggcacctttagtaagagaagccattgaaaaaattaataaatgcaccgtagaagctattgaacttaaatcctatccgttgacaaagatgaataatgctaccattgaaatcattagtggtcgtagtcagggtaaatcatgtcttattatggaagaagaagaagaagaagaagaaaaagaaaaagaaaaaggtagaaaaggagaacaatctgttggttatgaatgtcttccaggaaatatctttaaagaagataaatcctatttagttacaggagcctttggtggtgttggtttaagagtttgtctttggatgcaacttcgtggagctcatcatcttgtattgaccacttcttctaatcctgaaagtaaaaaggatcatccgatagtgaaggccttacgtcaacgtggcgcgcaagtctcgattgttaaatgtgatatatccaagtatgatgaagtagaaaagctctttaaggaaaccagtccatccctggatggagttttccactttgctaataaatttggaccaaaacttattcgtgattctggtcttgaaagctttattgccacctatgaacctaaagctcgtggagctcttaatcttcataagattagtcaaaagggttatcctctctccacctttgtcctcttttcctctgtcctcgatcttctcggtaataccggtcaaattgcctatggtggagccaatgccttcctcggtaatcttgtatattaccgtagaagacaaggactctctggtcaatgcttctccttacccgccatgaaaggttcaggttatctttcacaatggaaacaggaaggacaattccgtgaattttcagagattattgaattcctggactctgaagatttaccggatattttagactttttcataagaga

SEQ ID NO: 26306 - DNA, 2133 bp, Neocallimastix californiae
  POLYKETIDE SYNTHASE-RELATED
caatgcgatcgccatcattggtatgggtttacgtcttccaggtgctattaataatgaaaagaccctctggtctgctttagttaaaggtagagattgtgtttccaatattccaaaggatcgtaaactccatgaatcctacgtaaataaaccatctaatgaacttaacccaggagaacataatgttaagaaatgtggttactacgactctcgtacctctggtgaaaaagtttctcaatttgatgctgaattctttaactgtcttccagaagaagccattggtcttgatccaaagcatcgttggattttagaaactagttgggaagccttagaaaatgctggtatctctccagattctcttgaagattccaacactggtgtctttgtcggtatcggtgatcagcaagaccatgcccaattcatgaaggaatgccataggaaaaaggttgtcagttaccacaacagtaatccatctgctattgctggtcgtctcagctacttctacaagctctatggtccttcagtgacagtggatactgcttgttccactggtgccaccgcccttcatacggcctgtcgctccatgatctatggtgattgtcgtctcgccatggtcactgcctctaagtatctcttttacccagaagaatttgaaatgaccagtaaggctagaatgacctctcctaatggtcgttgtgctaccttcgataaggacgctgatggttacgcgcccgctgaaggttgtgttaccttcatcttaaagtgcttagaagatgctgaacgtgataaggatcatattcttggtgttatcttaggaactagtagcggtcaaagtggcttccgtcaatccattagtgttccttcttttgaaggtcaagctagaaacattaagcgtgttatggaaattgctggggttaatccttccgatatctcctacgttgaaactcacggtaccggtaccccatacggtgatgccattgaaattcaaggtataaaccaggtctatgctggttcccatactcctgaacatccattagtcattggtagtatcaagaccaatattggtcataccgctgaaacctctggtttagccggaattgcaaaggttttagtggccatgaagaataagaccattccaagacaccttcacttcaagaccctcaatccagaaattgatttgaaatctgttccattagccattccaacccataatatgaaatgggaaactgaggaaggtaagccaagaactgctctcgtttcttcctatggtttacaaggtagtgccgtcaatattattcttcaggaatacattccaccagttcaagatgaagttgatcatgccaatgaccattccgtagaaaagcaactcagtcgtgatatcattggtattaaagaaaagtccctcttgaccattagtgctcgtgataaggctgctctcttagttcttggtcaaaagtatatcaatattttagataacatggatgccgatgaagatatcaacaatctttgctataccaccaatgtcggccgtcaacatttcgaaaatagaatcgttgctgtcggtgaggatgttaagagcttatccgaaagtttacaagatgttatggataaggtcttttctttcactgaagaggaagctgcttctgatgaggatgaggaaaccagtaacaatggtaaggttgatcttgatgatcatcaaacccttgctaaaaagagagtctttaagaatattggtatgatcttctctagtcattacaaccaagccaatagtattaccgatgaaatgtacaagtttgcttgctacctctaccgtacttatcctgtctatgctaaagccttagaggaatgtgatcgtatcatctctgaattaagtaactttaaggtcttattagttaatttgatcatttgtatgggtgaattagttcaaccagatcttttaaaggaatacaagaaacaagtcgatgaagatccatgtatggctcaattcattattctttcgatgaactatgcactcaccgcgctcttacgtcatttgaatatttctatcaatttagtcatgggagatggtttcggtgaagtcagtgccgctttagcttgccaaaaaattaccttaagaaacgcttttattctcattca

SEQ ID NO: 26307 - DNA, 1608 bp, Neocallimastix californiae
  POLYKETIDE SYNTHASE-RELATED
tggaaaaattgctattattggtatgggtcttcgtttacctggtgctattaacagtgcaaaatctctttggttagctttagctaagggtaaggattgtgttttacctccaattaaaactagagatttacatcgtaattacgttaataagccaagtgatcaattagatccaactgaacacaatattcctcgtttaggtttatacgatactagaaatagtgttgctaagccatctcaatttgatgctaagttcttcaattgtttaccagatgaagccttagctcttgatccaagacatcgttggattttagaaactagttgggaagccttagaaaatgctggtattccaccaaactctttagaaaattcttctactggtgtatttgttggtattaacgatgatcacgaatattctgatttattaactgaatgtggcgttaagagtccaattgctgctcatggtcaaagtccaagtggtattgctggtcgtttaagttacttctatagattatatggtccatccttcactatggatactgcttgttcaactggtgcttctgctcttcatactgcatgtcgttcattacaatgcggtgattgtgatttatctattgtttctggtgttaaattcatgtattcttccaaggatttctacatgacttgttctgctagaatgacttcaccacatggacgttgtgccacatttgataaggatgctgatggtttcgtaccaggtgaaggttgtgttaccttcatcttgaagcgtttagaagatgctgttcgtgacaatgatcacatcttatctgttgttttaagtactagtagtggtcaaagtggtttaagacaatctattagtgctccatcctcagaaggtcaagctattaatatgcgtaaggctatgaagtttgctggtattaaaccagaagatgtgtcatatgttgaagctcatggtactggtacaccattgggtgatgctcttgaagttcatgccttaaacgaaatttacggtggtagtcatactgaagaaaatccacttgttgttggtagtatcaagactaatattggtcacacttgtgaaactgctggtttagctggtattgctaaggtcattgtttcaatgcaacacaaacatattccaagaaaccttcacttcaataccttaaatccagaaattgatattaaatctattccaattcaaattccaaccaagaccttaccatggaactctactgaaccaaacaagccacttatcgctcaagtttcttcctatggtcttcaaggtagtattgttcatgtcttcttacaagaatatattccagaaaataaggaacaaggagaagctaaagaagctgaaactgaagttgaaaatgataaggaaaatcacgtattaacaattagtgccaaaacttattctgcattaattgaactttgtaataactacatgaatgttcttgaaaagatggaagaagaaaatgaagatgtttctgatctttgcttctcatctaatattggaagacaacactttgatgaattcagattatccgttagtggtaagaatgcttctgaattatacagtaatcttgaaaaggaattagaaaagttagagaataa

SEQ ID NO: 26308 - DNA, 1086 bp, Neocallimastix californiae
  POLYKETIDE SYNTHASE-RELATED
tgactactttaatgaagttgaacttgattcctccggtaccgtcttaattactggtggtactggtggtgttggtttcgatatctgtcgctacctcgttaaacaagctaaccttaagggtcttgtccttactggacgtcgaccagaaaccgatgaaaaggttgctggtaggttagccgaaattcgtgcccttaatccaaagattaagattacctatgtcaccgctaatgttggttctgaacaagaaatgaagaaggtctttgatgatattaactctggctctccagaagaagcccttgttggtgttatccatactgctggtaccaacgatgatggtttaatcttcaaccaatcctatgaacgtttcgcaaagttaattaacagtaagattgaaggtgctctctgcattgctaagcttacggaaggtttgaacttaaagttcaccattctcttctcctccatgacggccttcttcggtaaccgtggtcaaattaactactgtacggctaacatgttccttaacaaggtttgtcagttctaccgttcccacaacggtcgcaaggatattatgtctcttgaattagcagcctggccatctggtcttagttctatcattaaggatgataccttcatgtttaacgaaattaacagtataaaccttatatctaaccttttgaatcatgttgctgatattccagcagttgtctttggtggtcccgtcattaattggaatagggtctacgatagctctatttgtgatccaatcttccgtgctgttcgtccagctgatcgtccaagaattgactggagaaccgctaatgatagcgaatacgttaagaccgtccttacttcaggacaaaatagttccgaaaatattgcagaagatgcggcagtagctagtgatccaaaggaaatttctaaagataatatctttgagattatggagaccgaattaaagagaattcttcaatacggtgaaaatgatgaaattgatccttaccaatccttaaccgaattaggtattgattcccttatgatgatggaattccgtactatcctaaagaatgttactaccgtcaatattccatt

SEQ ID NO: 26309 - DNA, 1476 bp, Neocallimastix californiae
  POLYKETIDE SYNTHASE-RELATED
agaatgtgtcggtaccattgttaatgttggtagtagagttaagaacttcaaaagaggtgattttgtttttggtattagtttctatgctgactacgttccttcctcctacgtcaagattcctcaagacttggtggttgttatcaatgaaaaggatagtcagaaacagcaacgccttatttcctcagtttatgcttatactgttgcactctatttattgaatgatattaaagaggatgaatctattcttttctctacaggtgccaatgatttaatgcaagctctggttactgtagctaaacaaaaacgtattcccatccttttggatgatgtctctcaaaaatacagtagaagtggtaatcctatctttaccaaccttcttaaggatcaaagaatagtaaattctggagatcatgaccaatgtcttcatcatgttaaacagttaactaatggtcatggagtccactatgtcatcgacgccaatgtcaaatcggacagagaaaatgttttgaaggaatgtctaagccataaaggtgaatatattagggttggtcattttagtcaaaatgttattaaaaagagtatatccaatagagtcattcaaatgaatgctcttagtaccaaggaaatctcaccaatagtaagaaaggctatagaaatgattaatgactattctgtggaagccattgagctcaaaacctatccactctcacagatgaatcgtgccatccttgaaataattagtggtcgtagtcagggtaaatcctgtcttgtgatgggagaggaagatattgaatatgattgtctaccaagtcgtgtctttaaggaggataaatcttatttggtgaccggggcttttggtggtgttggtttaagagtttgtctttggatgcaacttcgtggagctcatcatctcgtccttactacctcctctaatcctgaaatgaagtatcatcatccaattgtgaatgccttacgtcagcgtggtgctgaagttaccattgtgaaatgtgatatttcaaagtataatgaggtggaaaaactttttaaggaaactactccagtgattgatggtgtcttccattttgctaataaattcggaccaaaattaattcgagattccaacctttcaggttttatctccacctatgagcccaaggcacgtggagcgctcaatcttcataaagttagtcaacagggttatcctctctccaacttcgttctcttctcttctgtattagatcttcttggaaataccggtcaaattgcttatggtggtgccaattctttccttggtaatcttgtctattatcgtagaagtaaaggactttcaggtcagtgcttctccttaccagcaatgaaaggttctggttatctttctcaatggaaacaggatgaacaatctcgtgaattctcggaagtcattgaattcttggatgcagaagatttaccagatattttagactttttcctcagaga

SEQ ID NO: 26310 - DNA, 2392 bp, Neocallimastix californiae
  POLYKETIDE SYNTHASE-RELATED
tgctgtggttggtattgctttaagacttccaggtggtatcaacaccgttgataagtattggaaaagtttagaaagtggtagattctgtatctctccaactggtactaatcgtcttcttcatcacaacctgactcacaatgaacacttaaatcctggagaacattatattttcaactactgtcgttacgatagtacttctgacgtttcccctatcactgatttcgatccattgttctttaacatgaatccaagtgaggctaccgttctcgatccaaaattccgttgggtcttagaaactacttatgaagctttccaagatgccggtataaacccggataccctttctggtactcgtactaatgtatataccgctccaggtcaagttgatgaaatgaatacctacactattgatgcctccccaaccggttacagtattcttaacggtatgagtatgcacagttgtgctgctgcttctttaccaggtagaattagtttcatgtataacttgtacggtgctgcccacactgtagataccgcttgttcttccggtttagtagctactcatgatgctttcaaggatttaaacatcggtgaaactgatcttgctatcgttaatgctgctcactgtccatttcaaagtagtggtttcagtcttttgtctgttgctaagatggtttcaagaaattgtagatgtgctgcttacgatgaagccgctgatggatatgttcctggtgaaggttgtgtctccattatcttaaagagaaaagatgatgccatccgtgatcacaacaaaatttatggtttaattaatgctacagctgtcggtcaaagtggttcaagagcttctatgagtacaccatctgctattggtcaaaagatcattcatgaagaagtcttaaagaatgccaaccttactccaaaagatattgactatatggaaggtcatggtactggtacaaaattaggagatcgtattgaaggagaagccatcaatgaagttttcaagggatctcactctgaaagtcgtccattaacattagctagcgttaagactaacattggtcacactgaagaagttagtggtttagcctctcttgttaaggtcttattagccatgaaatacaagaccattccacctcaccttcacttccataaaccaagttcctccattgatttcgattctgttccattacacattccaactcaaaaggaagaatggaaagcccatgacggtaagaatcgtattgccctcgtttcttcctacggtctttccggtagtgtctgtgatgctgttgttgaagaatacgttgaccctgaagttaaagaagtttatccggtcaacaatacttaccatgtacttaccatcagtgctaagaacaataccgctttaaccgcagtagctgaacaatacattactctcttagaaagtcttgataagaatgctccaattgctgatctctgttacaccagtaatgtaggtcgtcaacactttaactacaggtatgctgttgccggtagaaatgcttctgaattagcggctgaattaactgaattcgttaaccaaaataagaaggccgttcgtacctttaaggaagaggtaggtatgtccttcactggtcaaggtagtatcaagccaggcgttggtcaagaattattcagaagtcaaccagttttccatgcagctatggaaaagtgcgatgctgttgttaagaaggttaccggtgtttctatcattgatgccctctatgatcaaagtcaagcccatcacttaaagaaggctcaaattgctcaacctgccttattcgcttatgaatatgccatgtgtatgctttggaagtcttggggtgttgaacccgtcatcgtcaatggtcacagcttaggtgaaattgtggctgctgctgttactggtgctatcgatattgatttagccatcgatttcattattgagagagccagatgtatgggtgaatatggtgaaaagcctggagctatggtcagtattttccaaaatgaaaaaactgtcaaggaagccattgaagaatttggttacgaagaagaagttgcgattgcggccatcaatggtgtcactcataccgttatctctggttatgaggaggaggtcgatgatattacccaatactttagtgaaatgaacattaagacgaagaagttaaacgttaccgatgctttccattctccattaatggacccagctatcgaagaattaaataactggattgaagaaaaggatgatgctaagttcagacagtccttaaaggttaagttcatctctaatcttgatggtaccattaagccagttggtgatcgtcttgaagaagattactgggctaaacacgctagaaatgctgttcgtttcgttgatggtgttaag

SEQ ID NO: 26311 - DNA, 2202 bp, Neocallimastix californiae
  POLYKETIDE SYNTHASE-RELATED
tgctattgttggtataggattacgtcttccaggaggtattaattcaaccaaaaagttctggttttcattaattaaaggtaagaattgcttatcagctacaccaacggatcgcgaacttcatttaggaatggtagatatgagtaagaagccaccggaatatcgactaaataaaaatgaacattatgtttgtagatatggtatttatgattctcattatgcctcatctggagtaaagtacactgattttgatgctaatttctttgactgctctaccgaggaagctattagcatggatgtcaagcagcgttggatgcttgaaacaagttgggaagctttagaagatgccggtatagatccttcctccatcgaaaattctgataccggagtattcataggaatgaacaattgctatcatcaaacaaagcttttgtcctccaagaaagccactaacattagctcttctttcaatccaaccacccttcattgtacagatctttcatcagtagctggacgaatttcctatttctataagatatacggaccagccatttctatggatactgcatgctcaacaggagctaccgcactacatacagcgtatcgttctatgcaatatggtgaatgtgatttagctattgtatccggggctcgatttctttactacaatgacgaatttattaatacttctcatgctaaaatggcatcaccaaatggacgttgtgccacttttgatgaagatgcggatggatttgcacctgcagaaggttgtgtgaccctcatcttaaaaagactagatagagctgaagaaaataatgataatatttatggtatacttctaggtagtagtaatggacaaagtggaggacgtcaatccatttctgttccatcttctgaagctcaagttcgtaatattaaaaatgcattaaaagatgctcatgtatctccaaaagatatatcgttcgttgaagcccatggtaccggtaccccttatggtgatgcaatagaaattcatgccttaaatcaaattttcaaagattcacattccaaaaaatcacccttatatattggaagtgtcaaaactaacataggacatacctgtgaagcagctggattagccggtattgttaaagtcttactctccatgaagcataatgtcattccaaaacatattaactttaaaaagttaaatcctgaaattgatttaagtatggttccattttgtattcctagtcaaaagaatattcgttggacatctccagatccttctaaaccgttaattgccgaggtctcttcctatgggttacagggaagtatcaccaacgttatacttcaacaatatcttcctccgaattggaccaccaaagttagaagtatcaataaaaaaatatcagaacaaaatgtcaatcctggtaatggaaaagaatggaatattgataatttcagtggaagaaaggaagtacaagaaggtgaagaagatgatgaatatgaagaagatgatgaagatattcgacacaaaaaatatttccttgttactgttagtgctaaaaatgaagcggccttactacatttaacagaagagtacataagtagcttagaagaaatagaagaagataaaaaacattggaaaagaagattagcaaactattgttattcctcaaatgttagccgaaagcatttcaatgtacgtatttcagctgtaggtgaaaatatttcaaaattaacggaagaacttgaaaatcaaatggatggtttatcttctaaactcaatgtttcaaatccaaaattaaaaagtagtcctataagtagtccacaatggaatacttccagtattggtgtctactatggagatgaaagtgactttaacctaaattttatccagtcaataaaagacgtttatcaaaattatgactactataaggaatgctttatctactgtgaacaaaagatacaaaaacttggaggagataaaaaatatccaatgtttgatgttgtttttgaacatgacaaaataaatattgataccctagatcctattgtgaagcgtttaattatattttcacatttctattctcttcataaacttttccttaattttaatattagtattaatgctattagtggaaaaggaattggagaatattttactttagccatttcctatgcactctctttagaagattcattgagactcctaattaacta

SEQ ID NO: 26312 - DNA, 2202 bp, Neocallimastix californiae; identical to SEQ ID NO: 26311
  POLYKETIDE SYNTHASE-RELATED

SEQ ID NO: 26313 - DNA, 2187 bp, Neocallimastix californiae
  POLYKETIDE SYNTHASE-RELATED
tgctatagttggtataggattacgtcttccaggtggcatcaattcaaccaaaaaattctggcattcattattacaagggaaaaattgtttatccactacacctgttgatcgtcaacttcacctgggaatgatagatatggctaaacaacaacctggatataaattaaataaaaatgaacactatattcacaaatatggttattatgattcaattcatacggcttctatagcaaagcctacaaagtttgatgctaatttctttgaatgtactaatgaagaagctattggaatggatgttaagcaacgatggatgctggagactagttgggaagctttagaagatgctggtattgatccttcaactcttgaaaattcaaatacaggtgtatttattggaatgaataactccaatcatcatataaaacttttatcttcagagaaagccactaatgtaggacctaacttcagttcagtcacacttcatggtactgatctttcttcagctgcaggtcgtatttcttatttctataagttatatggcccagcaatttccatagatacagcatgttcaacaggagctacagcattgcatactgcctatcgatctatgcaatatggtgattgtgatctagcaatagtttcaggtgctcgattcctttactataacgatgaatttattaatatttctcatgctaagatgacttcacctaaaggacgttgtgcaactttcgatgaaagtgctgatgggtttgcacctgccgagggttgtgtaacattaattttaaaaagacttgatgatgctgaagaaagtaatgatgacatttatggtattctccttggtagtagtaatggtcaaagtggaggacgtcaatcaatttctgttccttcctcagaagctcaagtacgtaatattagaaatgcactaatggatgctcaaatctctccaaaggacatttcatacattgaagcccatggtactggaactccatatggtgatgcgttggaaattcacgctttaaatcaagtttttggagaaagccatactaaaaattcaccattgtatattggtagtgtgaaaactaatataggacatacctgtgaagcagcagggttagcaggaattgttaaagttttactatccatgaaacatcaaataattccaaagcatattaattttaaaaagttaaatcctgaaatcgatttagaaactattccactttgtattcctagtcaaaaaaatattcattggacgtcttcagatccttctaagcctttaattgcacaaatctcctcttatggtttacaaggaagtgttacaaatattattcttcaacaatatcttccaccgcgttggactactaaagtgaacaatacgacaaagaaaaccatagaagaaaatataaatggtgattatatgaaagaagagaatattaataataaggttgaaatagaagcgtatgaggtagaggatgaaggagaagaagatgaagttcaacataataagtatttccttgttactattagtgctaaaaatgaagcctcattaattcaattaacaaaagaatatataaatgaattagaagaattagaagaagataaaaatcattggaaaagaaaattgacaaacttctgttattcctcaaatatttgcagaaagcattttaatacccgtattgctgcagtaggtgaaaacgtttcggatttaatagaagaacttgaaaatcgtattgaggatttatctttgatgttaaaaattgtaaatcaaaaatcaaaaaatagtcctcaaagtagcccacaatggaatagttcaaatattattatttattatggagaagaaaatgattttaacttagagtttattcaatcaattaaagagatctatcaatattatgattattacaaagaatgttttatctattgtgaacaaaagattcaaagtcttggaggaaataaaaaacatccaatgtttgatgttgtttttgatagtaattactctgatattaaaaatttagatcctatagttaaacgtttaattatattttcacatttctattcacttcataaacttttccttaattttaatgtcagtattaattctattggtggagaaggcattggtgaatattttgctctggccatttcaggtgtcctctcattagaagaatcattaaaactattaataaatta

SEQ ID NO: 26314 - DNA, 699 bp, Neocallimastix californiae
  POLYKETIDE SYNTHASE-RELATED
agatcttcttaaggatccttcaaccgctcttttaattagtggtattgttcaatttagcttggtatctctctataaatactatggtattacgcctagtgttgttattggctatggtgcaggtgaaattactgcggcgtatgcagctgaaaaaatagatttgaaggatgccgttcagattctttaccactacggtcaagtcctatccatggcaaacaattcatcaccaaaagtttactcttttctggttggttgtcctgtgggaagattgaatcatatgatggtttccaagttgactccatccgaaaaggatcttatttctatttctggtattccaaatccaagacaatgcattctttgtggtgagatggaaattttgaaaaaagttatgaagatgatcaaggatgaaaaggtaccaattctcagtggctttatggaaagctttggtatacattctaagataattacagaagctatgaaggatgaattaacaaagcgtcttgaaaacatttcatctcattcttcttctattgcgatgttttcaactgcaaaattcaatgagaagagcgaaccgtacactggtgctttagatggttcatactggtggatgaatatgagaaatccagtactttatgcccatactctttctcaaacagttaactaccttccttctgatggtaagaatattttagaaattggtct

SEQ ID NO: 26315 - DNA, 702 bp, Neocallimastix californiae
  POLYKETIDE SYNTHASE-RELATED
ggaagctttagaaaatgctggtattgctccaaattctctagaaaatactttaactggtgtctatgtcggtattaataatgaacatgagcatgaagatttattaaaaaaatgtggtatcgttccaccccttggttcccataccttaaatcaaagcagtattgctggtcgtttaagttatttttataaactttttggtccatccttcaccattgataccgcttgttccacaggttcttctgctcttcatattgcttgtaatgctatgaaacgtggagaatgtgatttatctattgttacgggtgtgaaatatatgtactcctccaaagaatttcataaaacctgttctgcccatatgacttctccaaagggtcgttgtgccacttttgacgccagtgctgatggttttgctcaaagtgaaggttgtgttacttttgttttgaaacgtttggatgacgctattcgcgataaagataatattttaacagttattcttggttcagttagtggtcaaagtggtttaagacaatcaattagcgctccttcctacgaaggtcaagctctcaacatcgaaagagcaatgaaaattgcaggtatcagtccagatcaagtatcctatgttgaagctcatggtactggtactcccttaggagatgctattgaaattcatgccctgaatgaagtctatgctggtagtcactccaa

SEQ ID NO: 26316 - DNA, 1656 bp, Anaeromyces robustus
  POLYKETIDE SYNTHASE-RELATED
ggatattaatagtaataaaattgctattattggtatggctttacgtttaccaggagctattaataatgctaaatctttctggatggctttagctaaaggtaaagattgtatttctacaccagttaaagatagaaaattacatcttggttatgtgaataagccatcccatcttttaaatgaaaatgaacataatattcctcgttgtggttgttatgattcacgttcaaatgttgctaaaccttctgaatttgatgcagaattctttaattgtcttccagaagaagctatggctcttgatccaagacatcgttggatattagaaacaagttgggaagctttagaaaattcaggtattgcaccaaattcattagaaaataccattactggtgttttccttggtataaatgatagtcatgattatcatgatttaatgaaagaaaatggtattacaccacctattgctgcccattctacaccaagtggtattgttggacgtcttagttatttctataaattatttggaccttctttcacgattgataccgcttgttctactggtgcttctgctttacattctgcctgtcgttcattacaatttggagattgtgatttatctattgtttccggtgttaaatatttatatacttcaaatgatttccatagaacaagtattgcacgtatgacttcaccaaagggaagatgtgctacttttgataaagatgctgatggatttgttccaagtgaaggatgtgttacttttattcttaaacgttatgaagatgctattcgtgatcatgataatattctttctgttatattaggtactagtagtggacaaagtggtattagacaatctattagtgccccatcttcagatggacaagttattaatttaaaaagagctcttcattttgctggtgtcgatccatccgatatttcatttgttgaaactcatggtacaggtacaccacttggggatgctattgaagttaatgctttaaatcaagtttataaaggaactcatacttctgagaatccattaattattggtagtgttaaaactaatattggtcatacaacagaagttgcaggtttagcaggtgttgctaaagttattttatctatgcaacataaatatattccaaagaatttacatttcaatacattaaatccagaaattgatattgaatctattccaattcaaattgctactaaaactataccatgggaaaataaaaataataaaccacgtattgctcaagtttcatcctttggtttacaaggaagtattgttcatattattcttcaagaataccttccagaaaaggaacaaaatgaaccaaaggaaccaaaggaaccaaaggaacaaaaagaacaaaataatgaaattgaaaatatggaaaataataaagatagtaaagatagtaaaaaagaagaagatcatattttaactattagtgctaaatcaccattagctttattagaattaagtaataattatttaaatattttagaaagtatggaagataataatgaaaatattgaaaatctttgttatacttctaatattggacgtcaacatttcaattatagaataagtgctattggtaagaatgctaatgaattatatgaagatcttgaacaaaaaattgaaac

SEQ ID NO: 26317 - DNA, 1632 bp, Anaeromyces robustus
  POLYKETIDE SYNTHASE-RELATED
tccaaaatctattgcttctaataaaaaggatagtgatagtaataaaattgctattattggtatggctttacgtttaccaggtgctattaataatgctaaatctttctggatggctttagctaaaggtaaagattgtgttactacaccagttaaagatagaaaattacatcttggttatgtggataagccttcacatcttttaggtgaaaatgaacataatattcctcgttgtggttgttatgatacacgttcaaatgttgctaaaccttctgaatttgatgctgaattctttaattgtcttccagaagaagctatggctcttgatccaagacatcgttggatattagaaacaagttgggaagctttagaaaattcaggtattgcaccaaattcattagaaaatacaattactggtgttttccttggtataaatgatagtcatgattatcatgatttaatgaaagaaaatggtattacaccacctattgctgcacattctacaccaagtggtattgttggacgtcttagttatttctataaattatttggaccttctttcactattgataccgcttgttccactggtgcttctgctttacattctgcttgtcgttcattacaatttggagattgtgatttatctattgtttcaggtgttaaatatttatatacttcaaatgacttccatagaacaagtattgcacgtatgacttcaccaaagggaagatgtgctacttttgataaagatgctgatggatttgctccaggtgaaggatgtgttacttttattcttaaacgttatgaagatgctattcgtgatcatgataatattctttctgttatattaggtactagtagtggacaaagtggtattagacaatctattagtgccccatcttcagatggacaagttattaatttaaaaagagctcttcattttgctggtgtcaatccatccgatatttcatttgttgaaactcatggtacaggtacaccacttggtgatgctattgaagttaatgctttaaatcaagtttataaaggaactcatacttctgaaaatccattagttattggtagtgttaaaactaatattggtcatacaacagaagttgctggtttagcaggtgttgctaaagttattttatctatgcaacataaatatattccaaagaatttacatttcaatacattaaatccagaaattgatattgaatctattccaattcaaattgctactaaaactataccatgggaaaataaaaataataaaccacgtattgctcaagtttcatcctttggtttacaaggaagtattgttcatattattcttcaagaatacattccagaaaaggaacaaaaggaacaaaataatgaaattgaaaaaattgaaaagaataaagatagtaaagaagatcatattttaactattagtgctaaatcaccattagctttattagaattaagtaataattatttaaatgttttagaaagtatggaagataatgaagaaaatattgaaaatctttgttacacttctaatattggacgtcaacatttcaattatagaatgagtgctattggtaagaatgctaatgaattatatgaagatcttgaacaaaaaattgaaac

SEQ ID NO: 26318 - DNA, 2544 bp, Anaeromyces robustus
  POLYKETIDE SYNTHASE-RELATED
tattattggtataggttgtcatttccctgaaggtatagaatcaaaagaagatttttggcaaatgcttgaagatgctcgttgtattaccaaagatataccaaaagaaagatgggataaagatgaatggtattctgaggaacctattcaaggtactattcaaacaaaacgtggtgcctttttaaagaatccttatctttttgataataaatatttctatatttctatgccagaagctaaagaaatgtcaccagaacaacgttggcttttagaattaactgtggaaactttagaagatgctaatataaaaccagaaactttgaaaggtactcgtactggtgtttttattggttcttctggttgtgattatttagctacacagatttctcatgctaatgatattaattctcattctcctactggatttgaactttcaattttagctaatcgtttatcctatgtatttgatttacaaggtccatcgattagttgtaatacagcatgttcttctgcgttttcagcattaaatattggtttaaatgctatgattactgatgattgtgaaatggcgcttgtagctggttctaatttcatgaattgccctggtggatttgttgctttttctcaacttcgtgtagtatcacctgatggttcttgtaaaccatttgatgaaaaagccaatggttatgctagattagaaggtgcaggtatggtattaattaaaccttatgaaaaggcagttcgtgatggggataaaatttattgtgctattgttggatgtggaagtaatgaagatggtcgttcaccttcccttactatgccatcttatgaagctcaatataaacttttaactcatgtttgtgaaaaatcgggtattcatccaactcaaattgattatgtagaagctcatggtacaggtacaaaagtaggtgaccccattgaatcacgggctattggtgatgcttatggtaaaagtaaaggtattcgtggtccaaatgatccaccaattttaattagttctgttaaaggtaatacaggacatggtgaaaattctagtggtatagtaagtattattaaaacttctatgatgcttcataaacgtcgtctcgtacccactgtagcttatcatcatatgaatccagccattaatgcagaaaaattaggtattaaagtatgtgaaactttagaagattggaaaacaccacatttattacatgctgctgttaattcctttggatttggtggtgctaatactaatactatattagaggaagtacctcatttaaattcaaaagatattcaacttcatatttcacaagaaaaacctatagtagccaaaatttctggttatagtgaaaaattagttttacaacaattagaaaaatggcgtcaagtaccaatagaaactcttttaccacaactttatctttcaaatacttgtagagaagatagtcattatcgtatatcttttattttagacgatccaaataaattttatgaatataccgatttagttttaaaaggtcgtagtcatattaatgtaattaaatataataataaaatatccgcaaaaccaaagttagcctttactttttcaggtcaggccactcaatacccagatatgggtcgtcaactttatcattctaatccttattttgctagtattattaattattgtaatgaaattattattcgtttgtcacaaaaagatcttattaaagatactggattgtttagtgatacaccagtagatgaagaaaaattaattgatccacaatattctttccttgctataggtattattcaattagcccttgttgaattttggaaattatatggtgttgaaccagctcttgtttttggtcatagtatgggtgaagttgctgctgcttatgctgctggaattttaaccatagaagatgctatcttattactttataattatggtcttattagtcaaaatgttgatgatattcatgaaaagagtggtatgttagctcttggttgtagtgctgaagaagctaaaactacttatttaaatggtaaagataaaaatagagtttatattgcttctattaatagtgaaaaagatataacacttggaggtgatcttaatcagttagatgctatcatgactcaagctaaaaataataatgttttcacggtaatgttaaaagttaaaaaggcattccatacaccatatattattacagcaaaacaaaaatttattcaaggcattcaaggtattggtagtagagttaattcaccaaaaattccatttatttcttcaacttatggtaaagaatatcaaggaccatttgatgaagaatattggtggactaatattattaatccagttaactttagtcaagctacaaaagtagctcgtactaaagtagaaaaagtattagaaattggttcaacaccggtattaggtatatatatgagtaaaattttcaatccagataatattttctattctttatcacgtaaattgaaagattatcatagtttaagtagaaatattgctaatatgtatgctaagaa

SEQ ID NO: 26319 - DNA, 2034 bp, Anaeromyces robustus
  POLYKETIDE SYNTHASE-RELATED
aaaaattgctattattggtatgtctttacgtttaccaggttcaattaatagtgctaaatccttctggatggctttagctaaaggtaagaattgtgttttaccacctgttaaaaatagagatttacatcatggttatgttaataaaccaagtgatcaattaaatccaggggaacataatattccatatattggttgttacgatactagatctaatgttgcaaaaccatcccaatttgatgctgaattctttaattgtttaccagatgaagcattagcacttgatccaagacatcgttgggtattagaaactagttgggaagcattagaaaatgcaggtattccaccaaattcattagaagattcacttacaggagtatttgttggtatgagtcaagatcatgaatatgctgatttattagctgaacgtaatattatagctcctattgctgctcattctaatactcaaagtggtattgcaggacgtttaagttatttctatcgtttatatggtccatcattaactatggatactgcctgttctactggtggatcagctattcatactgccgttcgttccttacaaaatagagattgtaatttatccattgtttcatgtgtaagatacatgtatacctccaagactttctataaaacatgtgctgcaagaatgacatctcctcatggacgttgtgcaacatttgataaagatgctgatggatttgcttctggtgaaggatgtgtttgtttcgttttaaaacgtttagatgatgctattcgtgataatgatcatattttaagtgttattataggtactagtagtggtcaaagtggtttaagacaatccattagtgctccatcctccgaaggacaagctataaatattaaaagagctatggaaattgcagatattaaaccagaagatgtttcctatgttgaagcccatggtacaggtacaccattaggtgatgcattagaaattcattccttaaatcaagtttatgctggtagtcataatgaagaaaatccattagttgttggtagtgttaaaactaatattggacacacaggtgaagttgccggtttagctagtattgctaaagttattttagctatgcaacataaacatattcctaagaatcttcatttcaatactttaaatccagaaattgatattgaatctattccaattaagattccaactaaaactataccatggacatcaccagttcctaataaaccattaattgctcaagtttcatcatttggtcttcaaggtagtattgttcatcttttccttgaagaatatattccaaaagaacaacaagataatgaatctactaaaaaaattgaaactgaaactgaagttgcaaatggaagtgaagtaagtgatgaagaagaaaaggaagaagtagaagaaattaatgaaaatgacagagaaaatcatattttaactattagtactaaatcctattcagctcttaatgaattaagtaatagttatatgaatattcttgaagaaatggaagatgaaaataaagatattcgtgatttatgttacacttctaatattggtagagaacatttcaatgattatagaatttcagcttatggtaagaatgcaactgaattatataatcatcttgaagaagccttagaaaagtttgaagaaaagatggaagttattaataaacaaaaagaaaatgaaactaataatatgaataattctaaaaaaccaaatcaaattcttaatgtttattctgaaaatattaaacaaggtattattaatgacatctttaaaaagttaatgtttgaattatacattgttcgttctgaattcaagaaagtcattgaattttgtgataattatatttatcaaatttccaataaggaattctcattaattgattaccttactaatgaaaataatgtagaaatttcaaaagaatatcaaaatatcatcattcttgtattctattgtggtttatctaaaattttaaataaagacattgattgtactcaacctgttaatgttgg

SEQ ID NO: 26320 - DNA, 2751 bp, Anaeromyces robustus
  POLYKETIDE SYNTHASE-RELATED
aattgcagttattggtatgggtattcgtttaccaggtggtattaatacccctggaaaatattggtctgctttagttagtggtagagattgtacatcaccaacaccaactaatcgtcaccttcaccactatttaaaaccaggatgtccagccaatgaattaggaccaatggaacattatatccatcgtggtggtttctatgataccactccagatgctgctccacttagtgattttgatccaacttttttcaacatttcaccattagaagctaaagctacagatccaaaatttcgttgggtttatgaaactgtttatgaagcttttcaagatgcatgtattaatatatctgaattaaatggatctcgtactagtgtttattgtactgtaggtcaaattttggattatgtttctgtagctagagctttcaacaaaagtgaaaatatgacaagtcaaactatgcatggaagtaatccttctagttgtgctggtcgtattgcttttaattatggtttcaccggtccatctgatactattgataccgcttgttcaagtggtttaaatgatgttaacaatgcttgtaaggccctttcttgtggtgatactgatttagctgttgtttcagctgttcatcaacaaattattggtactcaatttcatgttatttctgttgctcaaatggcttctcatcttggtcgttgtgctactttcgatgctgaagctgatggttatgctccaggtgaaggatgtattagtcttattcttaagcgtttagacgaagctgttactgatcatgaccgtatttatggtgttattactggtatttctacagctcaatcaggtactagacgttctatttctactccagctgttggcccacaagcagaaaatatgagaagagttttatctatggctaatattaatgcatctgatgttgattatcttgaagctcatggtactggtactccagtaggtgatgctattgaaactgaaactttaaatcttgttttcggtaaaactcataccgaaaagaaacctttaattgttggtagtgttaagactaacttaggtcacacagaagaagtttctggtttagctggtttatgtaaagttcttttatctatgtcacatcgtataattccaccacatcttcacttaaagaacttaaatccacgtattgatctttctgttattccaatgactattccacaaaagaaatgcatttggaagagtccacgtggtaaaaagagaattggtgttgtttcctcttttggtttacaaggtagtattgctaatgctgttgttgaagaatttaaacttccaaagagtgatgatcaacgtttagatgaaggttatgatctttctatgtatcacattttaactgttagtggtaagaataagaacgctcttattcaacaaattgaagaatatattagtatatttgaagctatgaatgaagatgatagtattgctgatatttgttattctactaatattggtcgtcaacactttagtccataccgttattcagcctatggccgtaatccatctgaattaattgaaaacttaactggtttcttacaacatgttgatgttggtcgtcgttaccaatcaaaatcatctgcttttgcattcactggtcaaggtgttgctaaggttggtatgggtaaacatttctaccaaacacaaccagtcttccgtaaggctatggacaaatgtgatgaagtcactcgtcgtcttcttaatgtatctattgttgaagttttatacaatatttctaatgcaccaaatggtattgaaaaaggtgaaaatgctcttaaaaaatcttctgttgctcaaccagccttatttgcttatgaatatgctatgagtcaactttggataagttggggtgttgaaccatctatggttcttggtcactctcttggtgaaattgttgctactactattgcaggtggtattgatttcgaattagctatggaattcattgttcaaagagcttcttgtatggaaaaatatggtattaaaccaggagctatggtttcaattttcactactgaaagtgctgtcaaagaagctattgaagaatttgaatttgaaaatgtttctattgctgctattaatggtactactcaaactgttatctctggtaatgctgatgaagttaaagaattagaagaatatttcattgaacaagaaattaaggctaaaccattaaatgttactgaagctttccattctgctttaatgaatccagctattgaaaagttatacgaatggattgaaactaaaccagatgataaattccgtaaaccattgaagtacggtcttatttctaatgttactggtgaacttattccagctggtgaacgtcttccaaagaactattggggtgaacatgcaagaaatgctgttcaatttgttaaggctgttgaaaccttattagctaacagtgagactttattaaatgttattgaagttggtccatctaatgtcttaactaatatgagtgctcgtattttacgtgaaaagaagattgataaatacaccaatccattctttgtcgcttctgcttctccacgtgttgaagaagaaaagggattatttgaagctgtttctaaggtttacaatgttggtaaggatattaattggagaagtttccataaacgtgaagatatttacactcatgtttgtccaattcttaagaagactagtattccactttatccattccaacgttctcgttactggag

SEQ ID NO: 26321 - DNA, 6577 bp, Anaeromyces robustus
  POLYKETIDE SYNTHASE-RELATED
caaacaatcatctttagaacttcttagccaacttttaataactatgaaacaaataactcaaaaaccaggtattaatccagaatatgaaaatttaattcaagttgcagttgttggtattgctttaagacttccaggtggtataaatacagttgataaatattgggatgttttagttaatggaaaattctgtgctactccaactggtactaaccgtcatcttcatcattatatgactacagctgaacatttaaaaccaggagaacattatgttactaaatattgtcgttatgatagtactccagatgcagctccaataactgattttgatccaatgttctttaatatgaatccaagtgaagctgctgctcttgatccaaaattccgttgggttttagaaactacatatgaagctttacaagatgcttgcattaatccagattctctttctggtactcgtactaatatttatactgcaccaggtcaagttcatgaaatgaataattatactactagtgcttcaccaactggttttagtgtacttaatggtcaaagtatgcatggtgttgcttgtgcttctttaccaggtagaattagttttatgtataacttatatggtgctgcccatacagttgatactgcttgttcttctggtttagttgctgctcatgatgcttttaaagatttaaatattggtgaaactgatcttgctattgttaatgccgctcattgtccatttataggtagtggtttcagtcttttatctattgctcaaatggtttctagaaattgtagatgtgctgcttatgatgaagctgctgatggttatgttccaggtgaaggttgtgttaccgtcattttaaagagaaaagatgatgctattcgtgatcataataagatttatggtttaattaatgctgctgctgttggtcaaagtggttccagatcttctatgagtactccaactgttgaaggtcaatctagaattcataaggaagttttaaaattagctcatcttgaaccaaaagatattgattatatggaaggtcatggtacaggtacaagtttaggtgaccgtattgaaggtgaagctattaaccttattttcaaaggtactcactctgaaactcgtccattaactttagctagtgttaaaaccaatattggtcatactgaagaagttagtggtttagcttctcttgttaaagttttattagctatgaaaaataagactgttccaccacatcttcatttccataatccaaatccttcaattgatttcaaatctgttccattacatattccaactcaagttgaagaatggaaaccagttgaaggtaagaagcgtgttgctttagtttcttcttatggtctttctggaagtgtttgtgatgctgtcgttgaagaatatgttgatgataatgataataatagggaagtttatccagttaatgattcttaccaagttcttaccattagtgctaagaataatgctgctttaattgctgttgctgaacaatacatttctcttcttgaatcacttgattctgatgctccaattgctgatctttgttacactagtaatattggtcgtcaacatatgaattatagatatgctgttactggtagaaatgccagtgaattagctgctaaattaactgaatatgttcatcaaggtaaaaaaactgttcgttctgataaaactgaagttggtatgtctttcactggtcaaggtagtattaaaccaggtgttggtcaagaattatatagaagtcaaccagttttccgtgatgctattgataaatgtgatactgttttaaagaaggtcactggtatttcacttgttgatgttctttacaatccacaacaagctcatcatttaaagaaagctcaaattgcacaaccagctttatttgcttttgaatatgctatgtgtatgctttggaaatcttggggtgttgaaccaactattgttaatggtcatagtttaggtgaaattgttgctgctgctgttactggcgcaatggatattgatttagctattgatttcattgttgaaagagctagatgtataggcgaatatggtgaaaaaccaggtactatggttagtatttttgaaaaggaagatgttgttaagaaggctattgaagaatttgatactcaagaagaagttgctgttgctgccattaatggtgtagcccacaccgttatatctggttatgaagatgaagttgatgatattactgaatatttcaaacaaatgaatgtcaagactaagaaattaaatgttactgatgctttccactctccattaatggaaccagctattgaagaattagataaatggattgaaggaaaggatgatgaaaaattcagacaaccattaaaggttagatttatttctaatgttgatggtaagattaaggaagttggtgaacgtcttgatgaaaattattgggctgaacatgctagaagtactgttagatttgttgatggtgttaaatctatgattgaatctgaaaataataatatattagctgtgattgaagttggtccagctgctactttatctcatatgagtgcacgttatgttcgtgaaaatgaagctcttcgtggtaaaggtccacatttcattccaagtggatcagctgatcaaaatagtgaacaatatctctttgatgctctttctaacttctatatggttggtggtaatattgattggaatgctttccataaagcacgtgttgattctgctactggtaaggaaattccacatcatctttataacttaccactttatccattccaaagatctcgttattggttagaaactgctgaacaaatgaagacaccatttgattctggtaataatgccaattgggacctttataaatctgttactgttatcaacggtaataatgataatgaagttattgtttctgctccattaactccacaatatgttaaatatttaagtaaaaaccatgttattattggtcatggttgtgttccagctgctgcttatactgaatttatctttactgctatgaaagcacttaacaataatcgtgatgatcttattgaaattactgatgaaatgtttgttcgtaatccattagatattgaggaagattctgaagttgatttcattatgaaaaagagaggtgatcgttttgctatctatgcaaaattagatggtggtgttgaaaatcatatgttgaatggaagtgcttgtcttttaaaggatggtgataatgctaatcttcttgaaacattaccatccaaggaagaaatgaaatcctttattaataaatatcttaatgaagaaactatgtattctagtcaaattatttatgatagtatttttgaacatagtttctatggtggtggtttcccatctgttaaaggttttaatgttgctaaggatgaaaagggaggattccttatttcacgtcttgattcaaaggataaaactcttaataatattcgttcaggtctttcacaagtttatctttttgattcttctattcattctaatgctggtagaatgtgtcttgaaaaattacaaaagaaagaagaagacactggaccaaatgtaccattccttccatctacatttgaaaatattataaaaataaaaccaactccagatgaatgctatgttattcatagatttattgaaggaactgaagctaatagtaatttcacttccttctctgtttatgatttagatggtaatattgtagaatatattggttcctatcaaactcgtagagttaatatggaaaacttccaaactagtccagaatttgaaatttatgattatgaatttgttgaagttaaaagtccacataaagatatgaaaactcttccatatttctatattcttggtgatcataagggttatgctgatgctttcgttgaatatatgaaatcaaaagaaggtaataacttccattacattaaagcagatttcccaaataaggaagcttgtaatgaagaattaattgaaggtcatttaaaggaattaggtattactacttctggtatggaaaatgaagttattgctaccgttaactttatggctttcgacttaccacatttacaaccagaaaatattgatcatacaagtgatgaatttaaggaacttttaagacatacctatgaagataatttaattttcattcaaaatttcacacgtgttattgatacctatgaaattgaaagatctttctgttttgttaccaagaatgcttctgattattatgaaaatgaagttgatcttttacaagctcttatttatggtattacaaagagttattggagagaatttactgatacacgtgtctttgaagttgataatcatgaaagtgctactccaaaggaagtatctgaacatgtttatactgaagttgtttcaagtgttgatcgttacgatgttacacgtgaagttgtttatggtaaagataataaacgttatgaaaataagattagaaaagttgttgctccaagtgttaattacactggagaaggtagtcttgatttcagtggtactattttaattactggtggtctcggtggtgttggttatgatgtttctaaatatcttattaccaaaccaaatcttaaagctcttgttcttactggtcgtagaccagaaacagatgaaaaggttgctgctaagttaaatgatcttcgttctgctagtaaaaatgttaaaattatttatgccgttgctaatgttaattctgaagaagaaatgaaaaaattatttgatgatattgctgcttcagaaaatccattaactggtataattcatactgctggtactaatgatgatggtttaatctttaatcaatcctatgaacgttttatgaaattagttcctggtaaggtagaaggtccacttattattactaaacttactaaggatataccaaatttaaaattcactattcttttatcttctatgagtagtttctttggtaatcgtggtcaaattaattataccactagtaatgtatttattaataaactttgtcgttactaccgtgctcatggtagaaaggatatggttgctttacaattagctgcctggccatctggtctttcttcaattattcaagaaccaacattccatttgaatgaaattaatagtattaatttaattagtaactttgcttctgtaccaggtgatattccagcttctgcatttggtggtccagttattaaatggaatgatgttcaagatcatgctatttgtgatccaatgtatcgtccagtacgtccagctaatcgtccaagagttaattggaaggttgataatgatactgcttatgtaccaaaaagtgtttccagtagttctttagctcttaatgctggtatgggttcaaaaggtgattccggtattggtaataaatcatcttctaatgaagttacagaagataatgtttatgctattatggaaagtgaattaaagagaattcttcaatatagtgaaaatgatgaaattgatccatatcaatctttaacagaattaggtattgattctattatgatgatggaattacgtactattttaagaactgctacaggtgtaaatattccattagttgttttctcaacacaaaatatttgtctttcacgtcttgtagattatgttaaatctaaattagctaaagaaaaagaagaagctgctaaaaagacaccagaaattactgaagaagaaaagaaagctaaagctgcagaagaacaaaaggcaagagaagaagaagctaaacttatttctaatgatcaaattgatcaatggattgtaccagttccaggatgtgaagatgttgaagatccattaaatgtatttatattcttcccatctgctgatgaaggtgaaattgattacagtgaatatgtagaaaaaatggaagattctttacttttcactgttaaccttccaggttatggtgttagaaaggatgaaccatttattaatgattgggatcttttaattaaaaatattactaaagcaattattcaaacagatatttcaggtaaatttaaagaatgtaaaactattcactttgttggtaatagttttggtggtattgttgcatggaagactcttcttcaaatacaagcttatgaagatgaagataaagaagtaccaattatttctactttaattatttcaagagctattgctccaacagctaaacgtccaattgaattaggtggtgaagttttatctaatttaccaaatgaaggtattgctactttccttaaaggtattgaaagtaaagtagatttcagtgatgataaggcttatcttttaccaattattcataatgaatatttaatgaatgatgctgttactaatgaaagtaatatgaaaatacgttcaaaattattaatgttctctggtaaacaagataaaattattgatgataataatacatcattatggaaaaaggaagttagtgatgaatttagtgaatttacacaacatattaaaatgagaggtaatcattggttcgtaatgaaggatacctctaaatatttaaagaatattatggaaaatcttgat

SEQ ID NO: 26322 - DNA, 6342 bp, Anaeromyces robustus
  POLYKETIDE SYNTHASE-RELATED
aattgctattattggtgttggttgtcgtttaccaggtgatattactaccaaagaagacttttggaatatgttagttactaaacgtgttgttacatcagagattccagctgatcgttgggatcgtgaagaatggtatagtaaggaaccaatcccaggtactattcaaactaaacatggtggtttcctttctaatgcttatgactttgataataaatatttttctatttctcaagctgaagcacttgaaattactccagaacaacgttggttatgtgaacttgctgttgaaaccatggaagatgctaatatacgtccagaagaattaaagggtagtcaaacaggtgtatttgttggttcagcaggtattgattttggtggtaaccaattagtaaatacattacaaatgtctgcacacactatgactggtttagaaccatcaattttttctaatcgtatttcttacatttttgatttacatggtccatccattactagtaatacggcttgttcagcttctatgtcttcattatctatggcttgtaatgctatagcagttggtgattgtgataaggcttttgttgctggttctaatttcttacctactcctggtggttatgttgctttctcacaacttagagttgtttcaaagactggttcatgtaaaccatttgatgaaaaagctgatggttatgctagacttgaaggtgcttgtatgttattgattaaagattatgaaaaggcgattagagataatgataagatttatgctacaattattggtagtggtaccaatgaagatggtcgtacattatctattacccttccttcctctgatgctcaatgtgctttaatgaaatgggtatgtgaaaagagtaatattaaggctgatactattgattatgttgaagctcatggtactggaactccaactggtgatccaattgaagccagatctattggtaatgcttttggtaaggttgttcgtactccaggaagtaaacctcttccagtaggtacagttaaaggtaatgttggtcatggtgaatttttaagtggtgctattggtttattaaagacttctttaatgcttttcaataagcagttagttccaactgctgcttatgaaaaattaaatccaaaaattgatgttaatggattaggtattcgtgttgctgataaaaatgagccaatgataaaaattaatggtaaggttaatactccattacgtgctgcagttaactcttttggttttggtggtgctaatgctaatgctattttagaagctgttgaatccattaaggttgaaactgttgatatcattaagagggaaaatactttaccattaatggtttcctttactggttttactgctaaggctttagttgctatgataaaggaataccttaagttaccagtagaacaacttttaccaaaactttatttagctactactactagacaaatccatactcatcgtgttacctttttattagataatgctaatgaattttatgaattaggtaatgcctttgttgaaaataaatcacatcctaaagttatttataatcttgttaaggcttctcataaacaaggtattacttttgtctttagaggtattagtgaattaaattcaaactttagttatagtttatacaagtataatcaaaagtttgctaaaattgttgactattgtgataaggttcttgagaaagttagtcaaggtttatcccttaagagagattatggtcttttccagaaggaaaactttgatgaaaccactttaagagatccaaaaatttctgttattggtagtggtattattcaacttaccatggctcatctcttaaaatcctatgctattattccatcctctgttgttggttatagtattggtgaaatttccgctgcttatgccgctggtattatttccttagaggatgcggttcttattttatatcaatatagttctattttagaaaaggttccaggtaaggaagatatttacactgttgaattaggatgttcttctgatcaagctcaagttaatattcttagtcaattatctgctccagtttatattgttagtaatagtactagtaatatatgtacactctgtggtaatagtaccttcttaaatcaagctattcaaatggctcaacaattaaatatcccaattttatccaatttaacaccaggatcaaatggaatttgtactccatatcttaatgactttaaggatgaattctatgaatctttaagagatattggtagtagatgtaaggatccagttattccatttatttcaactactttaggtcaaccatttaatggtccattaaatgaattctattggtgggctaatttaactagtactgttaactttagttctgctctttcacttgctatgaatgagcaaccaaatggtagtggttatattttggatgttggtagtggttattctagtacacttttccataattatcttactgcttatacttcagaagataagatctttgctacctatgattctactggtaataacgatgcttatgccttcttatacactattgttaatctctttgaaagaaatgctataccattaccagctatggataagatttgggaaactagtgctgatgttgttggtgttgattcctttaaaaaaataagaagtgttaatttcatacttccaccacacgtttgggaacataaaactattaaaaagatttataataaggatgtttttattagtttaaaaaagaatcaagaacttactgaaagacaaaaggagcaagttcttttaactggtggtattactgttgatcatgatgataaattaaatgtcgaaattgcaaacttaaagaaggaaattagtgaaatgactaaaaaggaagctcaaaaggctcgtgatcttgccattgaaaatgcaaagaaaataaatgaaatgaagaaaaaatttgaaactgaaaaggaacaagaaattaaaaagaaggttgatgaagaaaaaagaattattttaaaggaagctagaggttttattagtaatgaaatgcaaaaaatgaaaaaaaatgcttcttccatctctaggactgcttctccagttccagttccagttccagttcaaaattcaaatccagttaaaactgctccaagtgttattagttattctggaaataatgaagcttggaattatgaaaatcataaatatttagttgatcatattgttggaaaggatgttgttttcccagctgctggtagtgtaagtcgtgccatgtatggatttaaacaaagtagaggtgaacataattttgatagtgaaaagataattgttttagaagatcttgaattccttcatttagccgttttccaaaaatccgttcaagatcaattaaatatgaaaggtccaattccactttctcttatagaagaaggtgagggtaaatatactcttattcaaaaagatggtactccagttagtaaaggtcatttctatgaaccacaacttactcaaactcgtgaagaaaatgctaatttattaaatgatgtaccaccatttgaagaatttgttaatagatgttctacaaaggttggtggtaatggtgttactgcctctcaattatatcatagaacggatgaattaggtcttaaatatggtccaaacttccaacttgttcaaaatggtagagcaggtgataatgttggatatgctcgtattaaggtagatgaagataaatccaaacttatttgtcatccagctgtacttgatgcttgtttccattctattattggtattggtattgctaatggtgaccgtcaaccattaccaaataaaattaaaagacttattattggtcgtggtggttatttcccacaaggtactattatttgtgctgctgatgtgataaagcatgacttaaagaatgttgttgttaatatttacatttatgatgaagaaaagaaaccaattgcaaagattgaagaaatggatatgattattcatccacttagtattttacgtaatgaaagatggataaaatatatgggtgaagaagttttagctccaagtgctcaagatcaattaccacttcaaaattgtactagtattgttgttattggtgaaaagaaacaagaatttgaaattaatagtttattattacctcgtattgctccattacaatctattatttatatgattttagataactatgatgaacaattcaaagctatgcttgctgctaatgttttagtaccatcctcaacatttgttattgatgttagatatttgataaatccatccattgattatgcttattctactatgaaatttttacttgaaaatcatttcaattttgtttacggtaatattgatactggtgataatttagtatttgatgaaacctatgaaaatatggctttcggtaatagtattgctggtttattacaagttgctcgtgcagaatctaagacaaatatgatttattctattcaagctgaaaatttggaaaagtttactcatggtttattaaggggtaatttacgtattgaagatccagatattagagttaaggaagactttagaattactgctcaaagaattattaagaatccagttattccagatattaagactaagaattatacattagaacacagttccactggtcaaattggtaaattaaaattccgtgaagtctttggtcttcctgaatgtagtccagatgaagtagttattaagattcatagtgttgctcttcaatttaaggatgttatgagtgtcatgaataacttaccaggttataatgtttatgaaccaggtatggaaagtaatggttatgtcgtaaagattggtgaaaatgctaaaaaacatattaacctaaaaatcggacaacctgtctttgcctttactcataaatatggtcatatggtttcaacctatggtaaagctcattataaattagttaagccaatgatgaataatgatatgaatccagaaaattacagttctgttattgttcttggtactgttttatatgctcttcgtgatcgtgcaggaggtgttaaaccaggtcaaagtattttaattcaatctgctgctggtggtgtaggtcaagctgctataaaattatgtaaatactggggtgctaaaatttatgttagtacttcaacaaaaaagagagaatatttaaagaatttatatggattggagtatattactgattcaagaaatccaaagattttctatgaagatattatgaaatggactaataatgaaggtgttgactttgtccttaatgctcttgcaggtgatggtattacctatggtttaaaatgtttaaaaaaaggtggatgttttgttgaaattggtaaaaagaatattattttgaatacaccattaggcttaaagagtttaatgaataatattaatttctgttctgctcatattgatttacttgatgttgacaaattgtctagtttaatgaatgaatcttttgagtttattaatacaggtaagattacaccaattccagtaactcttgtaccagtaaagaaatatctttctgcattctttaatatggcttctggtaataatgttggtaaaacatgtattgttatggatgatgattatgaaccaagttgtaaacctgttaatcttgttaaagaaagtaaatcttatttaattactggtgcttttggtggtgttggtttacgtgttgctttatggcttcaattaagaggagctaaaaatattattttaacaacttcaggtaatgctgaaaaacgtaataaaaatccaattgttgaaggtcttcgtaataaaggtgttaatgttttagtacgtcaatgtgatatttctgatattaatgctgtacgtaaattattccaagaagctaatccaccaattgctggtatattccatcttgctaataagtttgctccaggtttaattgaaagaacttccttagaacaattccatgttgcttacaatccaaaggcaagaggtgccttaaatcttcatttagttagtaagaattatccagttgatatgtttgttatgttctcatctgtacttgatcttttaggtaataagggtcaagctgcttatggtgctgctaattccttccttggttctttagttgaacttcgtcgttctcaaggtttatgtggttcttgtctttctttaccagctatgaaaggatctggttatcttgcacaatttaaacaagaaagacaagctaatcaatttaaaggtttaattacaatgttagattctgatgatttaccagaattattagatgaagttattcattatagtatgccaccaagtgttcttattcttaatga

SEQ ID NO: 26323 - DNA, 1818 bp, Anaeromyces robustus
  POLYKETIDE SYNTHASE-RELATED
taccaataatactattcctcgttcattaaatgatgaaactcattatgaaaaaattgctattattggtatggctcttcgtttaccaggtgcaattaataatgctaaatctttatggatgactttacttaaaggtaaaaattgtgttgtagccccagttaaaaatagagatttacatactaattatgttaataaaccaagtaatcaattacttccaaatgaacataatattccatattttggttgttatgatactaaatctaatgttgctaaaccttcacaatttgatgctgaattctttaattgtttaccagatgaagctttatcacttgatccaagacatcgttggattttagaaacaacttgggaagctttagaaaatgctggtataccaattaattctttaaaaaatacaactactggtgtttttgttggtattaatgatgatcatgaatattcagatttattagaagaaaatggtatttctattcctatttcttctcattctaatcatccaagtgatattgctggtcgtttaagttatttttataatttatatggtccatcttatactatggatacggcttgttctacaggtgcttcagctattcatgtagcttgtcgttccttacaaaatagagattgtaatttatgtatggttactggtgttaaatatatgtattcttcaaaatctttaagtaaagcttgttcagctagaatgatttcccctcatggtcgttgtgctacttttgatatagatgccgatggatttgtaccaggtgaaggttgtgttacatatattttaaaacgtttaaatgatgctattgaagataatgataatattttatctgttattattggtagtagtagtggtcaaagtggattaagacaatccattagtgcaccatcatcagaaggtcaagctcttaatattcgtaaagctatggaatttgctcaagttaaaccagaagatatttcttatgttgaagctcatggtacaggtaccccattaggagatgctatggaaattcatgctttaaatgaagtttatgctggtactcattcaaaagaaaatccattaattgttggtagtattaaaactaatattggtcatacttgtgaagttgctggattagcaggattagctaaagttattgtttcattacaacataaacatataccaagaaatcttcatttcaataaacctaatccagattttgatcttaattctattcctattaaaattccaacaaaaactcttccatggaattcattaaaacctggaaaaccacttatagcacaagtttcttcctttggtcttcaaggtagtattattcatcttattattgaagaatatattcctaaaaatatttctataaataaaaatgaaattaaaaatgaaaatgaaaataaaaatataaatgaaaaggaatatgaaattaaaaatgaaaatgaagatgaaaataaaaatattaatgaaaatgaaaatgagaatcatattttaactattagtgctaaatcatatgctgctcttattgaattgggttataattatataaatactcttgaaagaatggaagaagaaaatgaagatatttgtgatctttgttatacctcaaatattggtagagaacatttcaatgaatatagattatctgcttatggtaaaaatgctaatgaattatgtaatagtcttgaaaaagctttagatgatttagaaaataaaatacatgatgaaaacaaattaaatcatcataataataataataatatttcttcctctccttcttcttcatcattatcttcctctagaaaaattac

SEQ ID NO: 26324 - DNA, 1395 bp, Anaeromyces robustus
  POLYKETIDE SYNTHASE-RELATED
ttctataccgaaatcattatctaccgataaatctttaacggataatcttatagctattgtaggtattggattacgtctaccaggtggtattaattcaactcaaaaattttggctttctcttattaaaggaagaaattgtttatcaaatactccaactgatcgtcaattacatcaaggttttgttgatatgcaaaaaaatccaaataaaaatttagatattaatgaacattatattggtaaatatggctattatgaatctgttcgtggtaccgcaaaacccacagattttgatgcagatttttttgaatgttctaaagatgaagctattggtatggatgttaaacaacgttggatacttgaaacaagttgggaagctttagaagatgcaggtattgatccatctattattgaaaattctaatactggtatatttgtaggtatgaataattgtaatcatcacgtaaaattaatggcctctaaggaagctaccaatattaattcaaattataatagtattactactcatggaacagaattatgttctgtagcaggtcgtctttcctatttttataaattatatggacctgctatatcgattgatacagcatgttctacaggagcaacagcagtacatgttgcttgtcgttcaattcaaatgggagaatgtgatttagctattgtttcaggagctcgatatctttattataatgatgaatttattaatacatcacatgcaaaaatgacatcaccaaataatcgttgtgctacatttgatgaatcagcggatggatttgcatcttctgaaggatgtgttaccttaattcttaaaagattagatgaagcagaagaaaataatgataatatctatggagttattcttggatcaagtaatggacaaagtggaggaagacaatcaatttcagtaccatcatcagaagcacaagaacgtaatattcgaaatgcaatgaaaaatgcaaatgtatctcctaaagatatttcatatattgaagctcatggtactggtactccctatggagatgcattagaaattcatgctattaatcaaatatttggacatactcatactcaagattctcctctttatatcggtagtgtaaaaacaaatataggacatacatgtgaagcatcaggattagcaggacttgtaaaagttttattatccatgaaacatcaattaataccaaaacatataaatttccgtaaaattaatccagaaattaatttagatcttgtaccattaaatataccttatcaaaaatgtattccatggaaatcttcggatccaacaaaacctttaattgcagaagtttctagttatggattacaaggtagtgtaacaaacattatcttacaacaatatataccacctaattg

SEQ ID NO: 26325 - DNA, 5805 bp, Piromyces finnis
  POLYKETIDE SYNTHASE-RELATED
tttccaacaatcttcattagaacttcttagtcaacttttaatgacaatgaatcaaatggttcaaaaaccaagtgttaatccagaataccaaaatcaagttcaaattgctgttgttggtattgcgttaagacttccaggaggtataaatactgttgacaaatactggaatagcttagttgatggtagattctgtatctcaccaattggtacaaatcgtcaccttcaccactacatgtctaaagaagaaaacttaaagccaggagaacattatatttacaactatggtcgttatgattctaccccagatgctgccccaatttctgactttgatccaatgttcttcaacatgaacccaaatgaagcctctgctcttgatccaaagttccgttgggttttagaaactacttatgaagccttccaagatgcaggtattgatccagatgtcctttctggaactaatactagtgtatacactgctccaggtcaagtcgatgaaatgaatagatatgctattcttgcttctgatactggcttcagtgttcttaatggtatgagtatgcatagttgtgctgctgcttctttacctggtagaatcagtttcatgtataatttacttggtgctgcccacaccgttgatactgcttgttcttccggtttagttgctactcatgatgccgtcaaggacttaaaccttggtgaaactgatcttgctattgttaatgccgctcactgtccattcatgagctccggtttcagtcttttatctgtcgcaaagatggtctcaagaaactgtagatgtgctgcttatgatgaagctgctgatggttatgttcctggtgaaggttgtgtcactatcattttaaagagaaaagatgatgctattcgtgatcacaacaaaatttatggtttaattaatgctgctgctgttggtcaaagtggttctagagcttctatgagttctccaactgttattggtcaaaccaatattcataaacaagttttaaaaaaggctggtgttaatccaagtgacattgactatatggaaggtcacggtacaggtacaaaattaggtgatcgtattgaagcagaagctatcaacaatgtctttaagggtagtcactctaaggaacgtccattagttttagctagtgttaaaactaacattggtcatactgaagaagttagtggtttagcttctcttgttaaagtattattagctatgaaaaacaagactgttgcccctcatcttcatttcaaaaatccaagtcctttaattgatttcgattctgttccattacacattccaactcaaaaggaagaatggaaaccagctgaaggaaagaaacgtactgctttaatttcttcatacggtctttctggtagtgtcagcgatgttattgtggaagaatacattgaaccagaaaccaaagaagtttacccaattaatgatacctaccatgttcttacaatcagtggtaagagcaatgctgctttaattgctgttgctaagcaatacattgagcttttagaatcccttgatagtaatgctccaattgctgatatttgttatacttctaatgtctgtcgtcaacatatgaagtacagatatgctgttattggaagaaatgctgctgaattagctgctgaattaaacgaatatgttaatcaaaataaaaagaatgctcgttcagataaaactgaagttggtatgtctttcaccggtcaaggtagtattaaatcaggtgttggtttagaattatacagaactcaaccagttttccgtgatgctcttaacaagtgtgatgttgttgttaaaaaggctaccggtatttctcttattgacgctctttacaatccaagtcaaagtcatcacttaaacaaggcacaaattgctcagccagctttatttgcttacgaatatgctatgtgtatgctttggaaatcatggggtattaacccaactattgtcaatggtcacagtttaggggaaattgttgctgctgcttctactggtgctatggatattgatttagctattgatttcattattgaaagagctagatgcatgggtgaatatggtgaaaaaccaggtactatggttagtgtatttgaaaaggaagatgtcattaaggaagcaattgaagaatttggatatgatgaagaagtttctgttgctgctattaatggtgttactcacactgttatctctggttatgaagatgaagttgacgatatcaccgaatactttagtcaaatgaacattaagaccaaaaaattaaatgttactgatgctttccattcaccattaatggatccagctgttagcgaattaaataaatggattgaaagaaaggatgactccaaattcagacaagacttgaaggttaaatttatttctaatgtcgatggtaacattaaaccagttggctctcgtcttgaagaagactattggggtaagcatgctagaaatgctgttcgtttcgttgatggtgttaaatccatgattgaatccgaaaagaagttattagctgttattgaagttggtccagccgctaccttaactaacatgagctctcgtttcgttcgtgaaaccgaatcacttcgtggtactggtccaaccttcattgctagtagtgttgctgatcaaaacagtgaacaatacttatttaatgcactttgtaaattctatatgattggtggtaacattgattggaatgtcttccatcaacgtattgacccaacttctggtaaggttattccacatagtctctatgatcttccactttatccattccaaagatctcgttactggttagaaactgctgaacaatgtgctcaaccaattgatggtggttctaacaaggccaactgggatctttacaaatctgttactattatcagtaacaacgaaagcgaacttattgtcgctgctccattaacaccacaatacgttgaatacttattcaagaaccatgttatcacaggttatggttgtattccagctgctgcctacactgaattcatttacactgctatgaaggctatcaataactatgaagatgatattattgaaatctgtgatgaaatgttaattcgtagtccattaaatattaaggctgattctaatgttgatttccttatgaagaagaagggtgatcgtattgccgtttatgctaaagttgacggtggtattgaaaatcatatgttaaatgcttctgcacttctcttaaaggaaggtgaaaatgctgatctttttgacactcttccaaagccagatgaagttaaggccttaattgaaaagattatgactaaagaaaacactcattcatctgatattctttacgatagtattcgtgaaagtagtctttacggtggtggtttcccatctgttaaggaatttgctgttggtactaatgacgaaggttctactgttttagtttcaagacttgactctaaggatagaactattaataacatcaactctggactttctcaagtctacctctttgatgctgctcttcatagtgatgctggtaaggatacccttgtagctattaaaaaagaaaatatgggtgatccattccttccatcttcatttgaaaatcttatcaagtacaaaccaattccagatgactgttacgttattcacaagcacatggaaggaactgaaccaaatgcagctttcacatccttttctgtttacgatttagatggtaatatttgtcaatattgcggtgctttccaaactcgtagagttaagatgaagactaaagaaactgatccagaatttgaactctacactattgactttaaggaaattccaaccccaccaaaagaaattaccaagacaccattcttttacattcttgctgataacaagggttatgctgatacatttgtaaaatacatgaagagtaaggtttccgatttccgccacgtcaaaatcaatatgccaactaaggatgaatgttcaaaggaactcattcaacaaaatcttaaggaattaggtattaaggaatctggtatggaagaagaaactattgctgttgtcaactttatggctatgggattagaagttcaagaagcttcatctattgatccaagcagcactgcttttaatgatattttaagatctacctacgaaaataacttagtcttcattcaaaatttcactcaaattattgatgtttacgattgtaagaaatctttctgttatgttactaagaatgctactgattattggaagggtgaaattgatctcttacaaggtattgttagtggtatctcaaagagtttctggaaagaatatatggatattcgtgtctttgatttagataatgatcgcaatgcttccaaggaagacatttcttcacgtatatacacagaagttatgtcaagtgttgatcgttacaacgtttcattcgaagttatttatgataagaacggtaagcgttatgaaggaagaattaagaatttcaaatcaccagctgttaactttgctggtgaaagtgaacacaactacactggtactattttaattactggtggtcttggtggtgttggttacgatatctctcgtttccttatgaaacaaccaaaccttaagggtcttgttcttactggtcgtagaccagaaactgatgaaaaggttgctgctaaattatcctccattcgtgaagttaataaggctattaaggttacctatattactgttaatgttggttctcaaactgaaatgaaagaggttattagtggtattaaggctagtggtagtaaattaactggtattattcacactgctggtgttaatgatgatggtttaattttcaaccaatcctatgaacgtttcgccaaattaattaacagtaagattgaaggttctcactgtatcgctaagattactgaaggtatgaacttggaatttattcttctcttttcttctatgacttccttctttggtaatcgtggtcaaattaactattgtgttgccaatatgtttgttaataaaattgctcactactaccgtagtcacggaagaaaggatattatcactttacaattagctgtatggccatccggtcttacctcaaagattttagataataccttccaatttaacgaatacaacagtattaatttagtttccaacttaattagtcacccaggtgatattgctccagttgttttcggtactccaatcgtccaatgggaaaatgtttttgatcataacatttgcgatccaatctaccgttcagttcgtccagccaaccgtccaaagcttgatttcaagactgccaacgatcaaaactacattagagaagatactaccactacccaaaaagttactgaatccaattcaaagaaggaaatttcagaagataatatctatgaaattatggaacatgaattaaagaatgttctccaatacggtgaaaatgatgaaattgatccataccaatctttaactgaattaggtattgactctatcatgatgatggaattacgtactattatgagaactgccactggtatcaacattccattagttgttttctccactcaaaacatttgcctttaccgtcttgtagaatatgttaagagtaaaatggttaatgaaaagaaagaagaagccgatgctaagactccagttatttctgaagaagaaaagaatgcaaagaagattgaagaacaaaaagcaaaggaagaagctgccaagcttatttctgatgatgaagttaatcaatggattgttccagttgaaggttgtgaaggtattgaagatccattaaatgtctttattttctt

SEQ ID NO: 26326 - DNA, 1764 bp, Piromyces finnis
  POLYKETIDE SYNTHASE-RELATED
cggtattgaatctttagcaactattaaattagcaaacattttatcaagaaaattcaataaaagatattcaccagctattctttttaattatggtaccaccatgcttcttgctaaacatataactggatatgaaaacacaagttacagcagtcaattattggataaaatcccaaaggaattagataacaaaagctccaacaaaattgcaattattggtatggcacttcgtttacctggtgctatcaataactcaaaatctttatggatggctttagcaaagggtaaagattgtgtattacctccagttaaaactagagatttacacactcgctatgctaataaatcagctgatcaattagaattagatgaacattatcttccacgtattggttgttatgatactcgtaatagtgttgcaaaaccatctgaatttgatgcttcatttttcaattgtttaccagatgaagcagttgccttagatccaagacatcgttggattttagaaactagttgggaagctttagaaaatgctggaattgcaccaaattcattaaaaaagactacaacaggtgttttcattggtattaacaatgagcatgagcatgaagatttattacatgattgtggtattatccccccattagcttcacatgctactgcacaaagtagtattgctggtcgtttaagttacttttatcaattatttggaccttcatatactattgatactgcatgttctaccggtagttctgcactccattctgcctgccagtcattacaatgtaatgattgtaatttatcaattgtaactggtgtaaaatatatgtattcttctaaggaattccataaaacatgctcagctcgtatgacatcaccaaatggtcgttgtgctacctttgatgctagcgctgatggatttgcccaaagtgaaggttgtgtcacatttatattaaagcgttttgatgatgctgttcgtgataatgataatatcttagctgttgttcttggttccgctagtggtcaaagtggtttaagacaatctattagtgctccttcttctgaaggtcagactgttagcattaagagagctatggaaaaagccggtattacaccagaacaagttagtttcgttgaagctcacggtactggtacaccattaggtgatgcacttgaagtccatgctcttaatcaagtttatggtggcagtcacactgaagaaaatccattaattgttggtagtattaagtccaatattggacacacatgtgaagctgctggtctagccagtattgctaaggttatcgttgctatgaagtataatcttattccaagaaatattcactttaatgaacttaatccagaaattgatctttcaactattccaatgaaaattccaaccaaaacattaccatggaatccaccaaatgatgatacaccacttattgctcaagtatcttcctttggtttacaaggtagcattattgtcaccttcttagaacaatatgttccagaaaagaagatagcccttcctaagaaagaacaacatatcttaacaattagtgccaaaacataccctgctttattagatttatacgataactattgtagcattctagaaaatatggatgatgatgaagatatcagtaatttatgttatacatccaatattggtcgtgaacactttgcctacagattggttgcaactggtacaaatccattaacactttataatagtttagaagaagaaatggaaaaattagaaaa

SEQ ID NO: 26327 - DNA, 1101 bp, Piromyces finnis
  POLYKETIDE SYNTHASE-RELATED
agaaacaagttgggaagccttagaaaacgcaaatattgctcctaattctttagaaaactcatctactggtgttttcgtcggaattaacgatgatcatgaatactcggatttaatgactgaatgtggtattgaaacatcaatcgctagtcatggttcaagtccaagtggtatcgctggtcgtttaagttatttctatcgtttatacggcccttctttcacaattgatactgcttgctcaacaggtgctaccgcacttcacactgcttgccgttcattacaacatcatgattgtaacttatctatcgtttctggtgtcaaatatatgtattcttcaaagaacttttataaaacatgtgctgccagaatgacttcaccacatggtcgttgtgctactttcgacaaagatgctgacggtttcgttcctagcgaaggttgcgtcacttttattttaaagcgtttagacgatgctatccgtgataacgataacattctttctgtcattttaagtacgagcagtggtcaaagtggcctaagacaatctattagcgctccttcctccgaaggtcaggctatcaacatgcgtaaagctatggaatttgctggtattaaacccgaagacgtttcttatattgaggctcatggtactggtactccattaggtgatgctttagaagtacatgctttgaacgaaatttatgctggaagtcatacagaagaaaatcctctcgttgttggtagtattaaaacaaatattggtcatacttgcgaaactgctggtttagctggcatcgctaaagtcattgtttctatgcaacacaaatatattccaaagaatcttcactttaatactttaaatccagaaatagatgttaaattaattccaatgaaaatcccaactaaaaatctaccttggaattcttctgatccaaataaaccacttatcgctcaagtctcttcttatggtcttcaaggtagtatcattcatgttttcttagaagaatacattccaaaaaacaaaaatactgaaaataacgccaataaaaaaaatagtaacataaatagaaatgaaaatgaaaataaaaacgaaaatgaaaatgaaaa

SEQ ID NO: 26328 - DNA, 355 bp, Piromyces finnis
  POLYKETIDE SYNTHASE-RELATED
tattccttcttcttcacctcatgaaaagaaaaatagtgaaaagatcgctatcatcggtatgggtcttcgtttacctggcgctattaacaatgctaaatctttatggatgtctttagctaaaggaaaggattgtgttttaccacctcttaaaaacagagacttacatcgtaattacgttaataaaccaagtgaattgttagatccatcagaacataatatccctcgtttaggtctctacgatactagatcaaatgttgcaaaaccatctcaatttgatgctgctttcttcaactgcttacctgacgaggctttatctctcgatccaaggcaccgttggatcttagaaacaagttgg

SEQ ID NO: 26329 - DNA, 5094 bp, Piromyces finnis
  POLYKETIDE SYNTHASE-RELATED
taactcttttggttttggtggtgctaatgctaatgctattttagaatctgttgataaaattgatgtcgaatcagttgatattgtcaagagaggcaataccttaccattaatggttactcttactggtttcagtgctaaggcattagttagtgttgttaaggaatacatgaaattaccggtaaaacaacttttaccaaaactttatttaatgacaactacaagacaaatacattctcatcgtgttaccttcttattagatgatgccaatgaattttatgaattagctaatgcttttgtaaacaatcaaccacatccaaaggttattcatcatcttgttaaggcctcccataagcaaggtattacttttgtttttagaggtattagtgagttaaaaaccaatttaggttatagcttataccaaaataataaaatgtttgctgatgttgttgactattgtgacaagattcttgagaagattagccagggctactctgttaagaaaaacaccggtcttttcttaaaggaaaacttagatgctgctacccttcaaagtccaaagatttctgttgttggtagtggtatgatccaacttgctatggctcatcttttaaagacctatggtattgttccatcctctgttgttggttacaatactggtgaaatcgctgctgcttatgccactggtattatttctttagaagatgccattcttattttataccaatttagtaatatattagaaaaggtcccaggtaaggaagatatctatacccttgaacttggttgttctgctgaacaagctcaatctagcataattaatcaactctctacttccgcttatattactggtaataatgctagcaatatttgtacactttgtggtagtagtgctgccttaaaccaagctattcaattagctcaacaatccaatattccaattttatctaatttaattccaggatcatgtggtatttgtactccattccttaacaatttcaagaatgaattccatgaagccttaaaggacattggtagccgctgcaaagctccagcaactccatttatctcaactactttaagtcaaccattcaatggtccattaaatgaatattattggtgggctaactttactagtactgttaactttaatgttgctctttcccttgctatgaatgaacaacaaaaaggtagtggatatattttagatgttggctgtggttattccaatgctcttttcaacaattatcttgcttcatacgccgaagctgataaaatctttgctacccatgatgtaactggtgccaacgatgctcttgctttcgtatatactattgctaatctttttgaaagaaatgctattccattaccttcaatggataaattatgggaaactagtgccgatgttattggtgtagacgctttcaaaaaaataagaagtgttaactttattttaccaccacatgtctgggaacataagactattaagaaggcttacaataaggaaattttcattagtttaaagaagaatcaagaacttactgaaaaacaaaaggaacaagttagtttaactggtggtatcactgtagaccatgataacaagtacaatgttgaaattgaaaagttaaaaaaagaaattaatgaaatttctcaaaaagaagctaagaaggctcaagaagttgccaaggaaaatgctaagaaaattgaagacatgaaaaagcaatttgaattagaaaaggaacaagaaatcaaaaagagggttgatgaagaaaaaaagattattttaaaggaagctaggggttatattactaatgaaatgacaaagttaagaaagagcgctgctaattctagaactgcttcaccattaccagttaagactccagccgaaaagattccagctgctccagctgttatgcattactctggtaataatgaatcatggaattatgaaaatcataaatatttagtagaccatgttgttggaaaggatgttgtcttcccagctgctggtagtgttagtcgtgcaatgtatggtttcaaacaaagtagaggtgaatataactttgataacactcgtaacattgtctttgaaaatcttgaattcttaaacttggctgtcttccaaaagtctgctcaagaacaattaaataaaaagggaccaattccactttctcttgttgaagaaggtgaaggaaagttcagtattgttcaaaagaatggtattccagtaagtaagggtcaattctatgagccacaacttactcaaagtaaggaagaaaacgctaacttattagatgatgttccaccatttgaagaatttgttaacagatgttctaccaaggttggtggtaatggggttactgctgctcaattatacaaaagaactgatgctttaggtcttatgtacggtccaaacttccaacttgttcaaaatggaagagccggtgataatgttggttatgctcgtattgaggtcgatgaagaaaagtctaaattaatttgccatccagctgttcttgatgcatgcttccattctattattggaacaggtattgctaatggtgaccgtcaaccattaccaaacaagattaaaaaattcattatgggtcgcggtggttatttcccacaaggtacaattatttgtgctgctgatattattaaacacgatttaaagaatgttgttgtcaatatatacatttatgatgaagaaaagaaaccaattgccaagatagaagaaatggacatgatcatccgccaacttaatgtattaaataataaaagatggattaagtatatgggtgaagaagttttggcctcatctcaacaagatttattaccacttcaaaatagttctgctgttttaattattggtgaaaaacaacaagaatcagaaatcacatccatattattaccacgtattgcaccattacaatctgtaatctatatgattttagataattatgatgaacaatttaaggccatgcttagttcaaatgtcttaattccacaaactactttagttattgatgtcagatacttggttaatccatccatagattatgccttcactacaatgaaattattaatcgaaaataacttcaaccttgtctatggtaatattgactctgctaataaattagtcattgacgaaacttaccaaaacatggctttcggtaacagtattgctggtttattacaagtagctcgtgctgaatctaagaataacttaatcttttctattcaatccgaaaaccttgataaattcacccatggtttattacgtggtaacttaagaattgaagatccagatattagagtaaaggaagattatagaattactgctcaaagaattattaaaaatccagttattccagaaattaaaaccaagaattacactttagaacacagtagtactggtcaaattggtaaattaaagttccgtgaagttttcggtttaccagaatgtggtccagacgaaattattattaagattcaaagtgttgcccttcaatttaaagatattatgagtgtcatgaataatttaccaggttacaatgtatatgaaccaggtatggaaagtaatggttatgttgttaagattggtgaaaatgctaagaagcacgttaatttcaagattggacaacctgtctttgcctttactcataaatatggacatatggtttctacctatggtaaagctcactataagttggttaagccaatgatcaataatgatatgaatccagaaaactacagttctgttgttgtcatgggtactgtattatatgctattcgtgatcgtgctggtggcattaaaccaggtcaaagtattttaattcagtcagcagctggtggtgttggtcaagctgctattaaattatgtcaatactggggtgctaaggtatatgtcagtacttctgctcgtaagagaaaatacttggaggacttgtatggattagaacacattacagattccagaaatccaaagactttctatgaagatattatgaagtggaccaacaacgaaggtgtggactttgtcttaaatgctcttgctggtgatggtattacctatggtcttaagtgcttaaagaaaggaggtcgtttcattgaaattggaaagaaaaacattattatcaatactccattaggtttaaagagtttaatgaataatatcaacttctgctctgctcatattgatttattagatgttgacaagctttctagtttaatgaacgaatcctttaaacttatcaacaccggtaaaattacaccaattccagttacccaagtcccaattaagaagtacctttctgccttcttcaaccttgcttctggtaacaatgttggtaagacttgtattgttatggatgatgaatatgaaccatcttgtaaaccagttaatcttgtaaaagaggataaatcatacatcattactggtgcttttggtggtgttggtttacgtgttgccttatggcttcaattaagaggtgccaaaaacattgttttaactacctctggaaatgctgccaaacgtaataagaacccaattgttgaaggtcttcgtagtaagggtgttaacgttaccgtttgtcaatgtgacatttcaaatattaatgctgttcgtaaattattccaagaaactactccacaagttggtggtattttccatcttgctaacaaattcttaccaggtttaattccaagaacttcattagaacaattccatattgcttacgatccaaaggctaaaggtgctttaaatcttcatcttgttagtaaggattacccaatagatatgtttgtcttattctcttctgtccttgatttattaggtaataagggtcaagctgcttatggtgctgctaattccttccttggttctttagttgaattccgtcgttccaaaggtttatgtggttcttgtatttctttaccagccatgaagggatctggttaccttgcccaattcaaacaagaaagacaagctaagggatttgaaggtttaattaccatgcttgattctgacgatttaccagaattattagatgaagcaattcattacagtatgccaccaaacgttcttattcttgatga

SEQ ID NO: 26330 - DNA, 1252 bp, Piromyces finnis
  POLYKETIDE SYNTHASE-RELATED
aatcgctattattggtgttggctgtcgtttaccaggtgatatatcaacaaaagaagacttttggaacatgttagttaccaaacgtgttgttacttcagaaattccatcagatcgttgggaccgtgaggaatggttcagtgaagatcctgttccaggtaccatacaaactaagtgtggtggtttcattaccaatgcttatgattttgataacaaatatttctctatttctcaagctgaagcttttgaaattactccagaacaacgttggttatgtgaacttgccgttgaaactatggaagatgctaatattcgcccagaagaattaaaaggaagtcaaactggtgtctttgttggttcagcaggtattgattttggtggtacacaattagctaatactcttcaaatgtctgctcatactatgactggtttagaaccatccattttctctaatcgtatttcttacatttttgatttacatggtccatcaattactagtaatactgcttgttctgcctctatgtcatctttatctatggcttgtaatgctattgctgttggtgattgtgacaaggcttttgttgctggttcaaactttttaccaactccaggtggttttgttgccttctctcaacttagagtcgtttctaaaaccggttcttgtaagccatttgatgaaaaggctgatggttatgctagacttgaaggtgcttgtatgcttttaattaaggattatgaaaaggctgttagagataatgataagatttatgccactattattagtagtggtactaatgaagatggtcgtactttatctattactctgccatcttcagatgcccaatgtgccttaatgcaatgggtttgtgaaaagagtaatatcaaggctgataccattgattacgttgaagcccatggcactggtactccaactggtgatccaattgaagctagatctatcggtaatgcatttggtaaaaaggttcgttctccaaatagtaaaccacttccagttggtactgttaaaggtaatgttggtcatggtgaattcttaagtggcgctattggtttattaaaggtttctttaatgcttttcaacagacaattggttccaactgccgcttttgaaaagttaaatccaaaaattgatgttgatggtttgggtattcgtgttgctgataaaaatgaaccattagtcaagattaatggtaagattaatactccattccgtgctgctgttaactcttttggtttt

SEQ ID NO: 26331 - DNA, 2934 bp, Piromyces finnis
  POLYKETIDE SYNTHASE-RELATED
tggtacaccattaggtgatgctattgagactgaaacattaaataaagcttttggtggtagtcatactgaaaagaaaccattagttgttggtagtgtcaaaacaaatattggtcacaccgaagaagtatcaggtttagccggtttaactaaggttattttatccatgtctcaccgtattattccaccacatcttcatttaaatactttaaatccaaaaattgatctttctgttattccaatgtctattccacaaaagaagagtatttggaagtgtccacgtggtaaaaagagaattggtcttgtttcttcctttggtttacaaggtagtgttgctaatgctgttattgaagaattcaagcaaccaaagagtagtgatattcgttacgaacaaggctatgatctctctatgtatcatatattaactattagtggtaagaacaagaatgctattatacaacaaatcgaagaatatattcgtatctttgaagctatgaatgaagaagattctatagcagatatttgttacagtagtaatattggtcgtcaacactttgcttaccgttgctctgctagtggccgtaacgctccagaattaatcgaatctttaacagatttattgcaacgtatgacttctgttcgtcgttatcttccaaaatcttccgcctttgctttcactggtcaaggtgttgctaaggttggtatgggtaagcatttctatcaaactcaaccagttttccgtaaggctatggacaaatgcgatgaagttactcgtcgtcttctcgatgtttctattgtcgaagttctttacaatatctcaaattctccaaatggtgtcgaagaaggtgaaaaggctcttaagaaatcttcagttgctcaaccagctttatttgcttatgaatatgctatgagtcaactttggattagttggggtgttgaaccatcaatggttcttggtcattcacttggtgaaatcgttgctacaactattgcaggtggtattgactttgaattagctatggaatttattgttcaaagagcttcttgcatggaaaagtatggtgtaaaaccaggtacaatggtttctgtatttactactcaagatgttgttgaagaagcaattgaagaatttggttttgaaaatgtatctattgctgctatcaatggtaccactcaaattgttatttctggtaatactgatgaagttaaggaattagaagaatacttcacacaacaagaaattaaggctaaacaattaaatgttactgaagccttccattctgctcttatggatccagctattgaaaaattatatgaatggattaatactaaaccagatgaaaagttccgtcaaccattaaagtatggtcttatttctaatgttactggtgaacttattgaggctggtgaacgtcttccaaagaattattggggagaacatgctagaaatgctgttcaatttgttaaggctgttgaaaccctattagctaatagtgaaactttattaaatgttattgaagttggtccagctaatgttttaactaatatgagttctcgtattttacgtgaaaagagaattgacaaatttgctactccattcttcgttgcttctgctgctcctcgtgtagaagaagaaaggggattatttgaagctgtaactaaggtttataatgttggtatgaacattaaatggaagaacttccaccaccgtgaagatattaatacacatgtttgtccaatccttaagaaggttagtattccactttatccattccaacgttctcgttactgggctggtccggatacaaccaaatatgatattccatttgctatgggtatagatccttgtgaaattaatagaatagcaaaggaagttggttacaaaatggaaggcttttccaatgaaggtaaaaatgaaaatgatgaaaatggcgaagtagaagatgaatataacaatgaattttctaatgaacaatttaatcgttttgaaacaccaactgttgttgatcttgatatgaatagtaattctggtcaaaagtctgcttctgaatcaaacattattattactgttccattaagtactcaatacattcgtttcttaagaagaaagcatcaaatttcttcaactggtttcagtccagctacttcctatattgattttgtattctatgctttaaaatacgcttatccaaacgaacaatttaagattgatgaatacttcattactaacggtccattaaagcttactgatgatcaagaagttgtttatattatgattaagaagggtgaagaagtcactatttattcacaaagtcgtggtagtccacaagaagttagaggatctgtcatgatatctgtagttaataatcttgataatgaagaagctacttccaagcttgattttgatattaaaaaggattatgtcgaaaagtatttaactgttgaaaatgctaataaatcaccaaactatggtgaaggtaaagaattatatcaagaattagataagagtattgtttatggaagcttctttagatcagttaaatctttctactctggtaaagatgaaaatggtcatgatttccttgttagtcatattatgcataatgtttcagataaagatgaatctcttgttaattctggtgcatcccaagtcggtatattagatgcttgtattcattgtatgggtggtgatggtattattagcaacagaaataatactaacaatgaaaagtctaaagatactttcctcccaacttcatttgaaggaattattaaatataaggatattccaaatgaagtatatgttcttcatcgtgtaaagaatgttaacgaaacctcaaagtttactgaatactttgttttcaatactgaaggaaagcttgttttctctactgataatttccaagtcaagaaattcgatactactcaaatttctaa

SEQ ID NO: 26332 - DNA, 5250 bp, Piromyces finnis
  POLYKETIDE SYNTHASE-RELATED
tggtacaccattaggtgatgctattgagactgaaacattaaataaagcttttggtggtagtcatactgaaaagaaaccattagttgttggtagtgtcaaaacaaatattggtcacaccgaagaagtatcaggtttagccggtttaactaaggttattttatccatgtctcaccgtattattccaccacatcttcatttaaatactttaaatccaaaaattgatctttctgttattccaatgtctattccacaaaagaagagtatttggaagtgtccacgtggtaaaaagagaattggtcttgtttcttcctttggtttacaaggtagtgttgctaatgctgttattgaagaattcaagcaaccaaagagtagtgatattcgttacgaacaaggctatgatctctctatgtatcatatattaactattagtggtaagaacaagaatgctattatacaacaaatcgaagaatatattcgtatctttgaagctatgaatgaagaagattctatagcagatatttgttacagtagtaatattggtcgtcaacactttgcttaccgttgctctgctagtggccgtaacgctccagaattaatcgaatctttaacagatttattgcaacgtatgacttctgttcgtcgttatcttccaaaatcttccgcctttgctttcactggtcaaggtgttgctaaggttggtatgggtaagcatttctatcaaactcaaccagttttccgtaaggctatggacaaatgcgatgaagttactcgtcgtcttctcgatgtttctattgtcgaagttctttacaatatctcaaattctccaaatggtgtcgaagaaggtgaaaaggctcttaagaaatcttcagttgctcaaccagctttatttgcttatgaatatgctatgagtcaactttggattagttggggtgttgaaccatcaatggttcttggtcattcacttggtgaaatcgttgctacaactattgcaggtggtattgactttgaattagctatggaatttattgttcaaagagcttcttgcatggaaaagtatggtgtaaaaccaggtacaatggtttctgtatttactactcaagatgttgttgaagaagcaattgaagaatttggttttgaaaatgtatctattgctgctatcaatggtaccactcaaattgttatttctggtaatactgatgaagttaaggaattagaagaatacttcacacaacaagaaattaaggctaaacaattaaatgttactgaagccttccattctgctcttatggatccagctattgaaaaattatatgaatggattaatactaaaccagatgaaaagttccgtcaaccattaaagtatggtcttatttctaatgttactggtgaacttattgaggctggtgaacgtcttccaaagaattattggggagaacatgctagaaatgctgttcaatttgttaaggctgttgaaaccctattagctaatagtgaaactttattaaatgttattgaagttggtccagctaatgttttaactaatatgagttctcgtattttacgtgaaaagagaattgacaaatttgctactccattcttcgttgcttctgctgctcctcgtgtagaagaagaaaggggattatttgaagctgtaactaaggtttataatgttggtatgaacattaaatggaagaacttccaccaccgtgaagatattaatacacatgtttgtccaatccttaagaaggttagtattccactttatccattccaacgttctcgttactgggctggtccggatacaaccaaatatgatattccatttgctatgggtatagatccttgtgaaattaatagaatagcaaaggaagttggttacaaaatggaaggcttttccaatgaaggtaaaaatgaaaatgatgaaaatggcgaagtagaagatgaatataacaatgaattttctaatgaacaatttaatcgttttgaaacaccaactgttgttgatcttgatatgaatagtaattctggtcaaaagtctgcttctgaatcaaacattattattactgttccattaagtactcaatacattcgtttcttaagaagaaagcatcaaatttcttcaactggtttcagtccagctacttcctatattgattttgtattctatgctttaaaatacgcttatccaaacgaacaatttaagattgatgaatacttcattactaacggtccattaaagcttactgatgatcaagaagttgtttatattatgattaagaagggtgaagaagtcactatttattcacaaagtcgtggtagtccacaagaagttagaggatctgtcatgatatctgtagttaataatcttgataatgaagaagctacttccaagcttgattttgatattaaaaaggattatgtcgaaaagtatttaactgttgaaaatgctaataaatcaccaaactatggtgaaggtaaagaattatatcaagaattagataagagtattgtttatggaagcttctttagatcagttaaatctttctactctggtaaagatgaaaatggtcatgatttccttgttagtcatattatgcataatgtttcagataaagatgaatctcttgttaattctggtgcatcccaagtcggtatattagatgcttgtattcattgtatgggtggtgatggtattattagcaacagaaataatactaacaatgaaaagtctaaagatactttcctcccaacttcatttgaaggaattattaaatataaggatattccaaatgaagtatatgttcttcatcgtgtaaagaatgttaacgaaacctcaaagtttactgaatactttgttttcaatactgaaggaaagcttgttttctctactgataatttccaagtcaagaaattcgatactactcaaatttctaaaaataatgatttcgttttatgcaatgttgaatggactgaatatccagttaaaccaattgttaacggtggacttcatgttattgtaattaaggataagaagggttatgctgatgcttttattaaagcattaaaggatcgtaacattactgaaaatgttattggtattgatcttccattacaagataattccaattccacatttgttaattgttaccgtgccattaaggcaaagagtacagctgaaggtattcttgctctttacaacttttctttacttgaccttgaagaatacactaccaaagaaactggtgatgaattagtaaagaaatacaaggacttttacattaattctcttgaaactactcaagctttcgttcgtacaactagtgaaatgaagcttaagagaactatagcatttgttactatggcttgttcagcaattaattcatctggtgctaacgttaatccattaggttatcttgttcttggtattttaaagaatgccaatcacgaattcttagatattcatggttgttcctttgatcttgaagctggcactccaattgatattgctactaaccaatgtattgatgaaattcttggtggtgttgaccgttatgatatgccatacaatattgcttataaggatggtaagcgtatgacagctgttcttacctatgatagaagttatgatagagctattactgaaccagttagtggtaatcttttaatcacaggtggtttaggtgatgttagtatggatgttattgaaaatttgttatctgataaggaaactaaacttgaccacatcttccttttgggtagatctagtaaaactagtactaaggttgaagataaattagatcgtattgaaaaaattaaaaaggccaataataagaaaactgaagttgaatactattgttgtgatatttccaatggagattcattaaatgacgtattcaatgatatccgtaagcgtcaaggtttacaaattaatggtatcttccataccgctggtactaatgatgatactttattcttaactcaaacttacgaaaagtttgaaaaattagctccagctaaggttattggtactcataatattattaagtacacagaagattttaaggatgaattaaagtttatcattttaacttcttctcttactgccctttctggtttaactggtcaaaccaattatactgctgctaacatgtttattgatgccattgctagatattgtagaaaccatggaagaaataatgttatgtctttagaactttgtggttggtctggtgcaggtaatgctgatgttttatcttcaagatctgaagtttttgttcttgacaaaattggaggtggcaatatgtttaaattattatttaagcttggcggtcaaactaaggaaagttgctgtgttggtttccctgatgttagtcatgaaaattgtgatgaagccattttccacgattatctttaccgtgttaatttacgtccaaagaatcgtccaagaactgatcttactactttatctcatcataatcttggtcaacatgatattgaaatttcagaagaagataaatctcttagtgttcaagatattttaaagaaagaaattcgtagaatgttaatgtacaatgaagatgatgaaattgacgaaatgcaaccactttctgaattaggtatggattctattatgatgatggaattccgccaagttattaaagctgtcactgatattatgattccactttctattatttcttcaccaaatgtttatctttctaagatttaccaataccttaataataaggctggtagtgatattacaggtggaagtaaaactcaaaaaagtatgagtagttcttctgtaagtgaaaaaaagaaatccagtgttgttgctaagagagaagaacttaaggcaaaaagagctcagaaaaaatctaaagccgcatcttcaaatgaaattgaagaaggcatgaaagattatggtgaatggcttattcgtttagatactaataataatattactaactcattcttccttttcccagctgctggtagttctatcagtatgtatggtaattggaacagttacatgaaaaactcagccttatttggtgttagttatccaggtcatttagtacgtttagatgaaactccaattgatgacttaaagactttagttagtgctattgctaaagaaattatggaaaatattaagaatggtaatattccaaaggatcaaccactttactgttttggtcactccttaggtgctcttgtttcatatgaagttgtaatgcttcttcaaaa

SEQ ID NO: 26333 - DNA, 712 bp, Piromyces finnis
  POLYKETIDE SYNTHASE-RELATED
aattgccgttattggtatgggtattcgtttaccaggtggtattaatactccaaccaagtattggaatgctttagtaaatggaaaagattgtatatcaccaactccaaataatcgtcatcttcaccatttcttaagaccaaactgtccacataacgaattaggtccatatgatcattatgttcatcgtgctggttattatgatgttgttccagatgctgcaccaattactgattttgatccaactttctttaacatttctccattagaagcaaaatttactgaaccaaagtttcgttgggtctatgaaactgtttatgaagctttccaagatgcttgtatcgatatttctgagttaaatggttctcgcactggtatttattgtactgttggtggtacatttgattacattggtttaactaaggctttcgttagtggtcaaactatgacaagtcaaactatgcatggttctgctgcttctagttgtgctggtcgtatagcatttaattatggtttcattggtccatctgataccgttgatactgcttgttccagtggtttaaatgatgtcaataatgcttgtaagtctctttcttgtggtgacactgatattgctgtagcatctgctgttcaccatcaatatgttagtactcaattccatgttatctctgttgctcacatggcttctcaaactggtcgttgtgctacctttgat

SEQ ID NO: 26334 - DNA, 280 bp, Piromyces finnis
  POLYKETIDE SYNTHASE-RELATED
tcgttgtgctacctttgatgcttccgctgatggttatgctccaggtgaaggttgtatcagtcttgttcttaagcgtttagatgacgctcttactaaccatgatcgtatttatggtgttatcactggtatttctacttctcaatctggttctagaccatctatttcttctccagctatcattccacaagttatgaatatcaaaaatgctttacaaattgcaaatgttactccagaagaagttgattatgttgaagcacacggtactggtacaccattaggt

SEQ ID NO: 26335 - DNA, 1515 bp, Piromyces finnis
  POLYKETIDE SYNTHASE-RELATED
tgttggtcatggtgaatacttaagtggaattattggtttaattaagagtaccttaattcttcataaaaatatgattgttccacaaacagcatttgatacccttaatccaaagattgaatgtgaaaaattaggtattcgtattgctaataagatagaaaaatttccaggtcaaggacgtcatagagttgctgttaactctttcggttttggtggtgctaatgcaaatgctattatagaagaggaaccccaatttgataaaaacaatatttctgtattattaaagaaaaataaaaatggtgaggaaattccatgcccatacgttgcattcttctcaaattccagtttacgtcttttaaaggaaactttaaagaagtggttatctgttccagaaaaggaattattacccatgatttatttgaattctaccactagaacagttttagcttatcgtatatttatttttgctaaaactaccgaggaattttatcgtactattcgtaactttatagctgatgattctcttgacaacggttacaaagtcacagatcagatgatgtacattgaaaccaagagtaatcgtaagaagggtactttaatggcttttgatgaaccattgacatatgtcaattccttccttaaacattctacatattacaattgttgtagaaatctttactgtaataataaatacttttctgattgtattgattattgtgatggtattttcaaggctttaagtcaacgttctcttcttcaagattacggcttatttactactgaaatgatggataacaataaatttaaaaaatttaattctgatcttagaaaggatccattagtcatgataatgtttggtggtatggttcaattaactttgtctgccttattaaaatattatggtctatttcctaatgcagttattggttatggtgctggtgaaattgttgctgcctatgttgctgataagatggatttaaagactacggttaaagttctttaccactatggtagagttttaagtcacgcttactctcaagaaaataaggtttatactcttactttaatctgtccaattagtaaaattaaacaaaccattttcaccaaactaaatcaagatgaaaaagatggcatatcaatttcgggtattccaagtccaaagttctgtttacttagtggtgactataatatcatgaaaaaggtttccgatattgccaagagtgaaaatattgccatttatggtgctatgcaaaataattatggcttacattcaatgatgattaatgataaaatgaaggaagatcttgtgaacagtcttaaggacattcctttacaaacttctgatattgctttcttcactaccactaagctcaataaggatggtaagccatacgaaggaaaactagacggtgaatactggtggatgaatatgagaaatccagttctttatgctcacgctttatctcaaacagtcgcctttttaccaatagatggtaagaatataatagaaattggttt

SEQ ID NO: 26336 - DNA, 1216 bp, Piromyces finnis
  POLYKETIDE SYNTHASE-RELATED
cattttacaatcagtattaataaattattaccctcatttaatacacatgtctactattccaaaagaaattcaaattgaaaatatgattgatccaacacagcaaacatcatctcttttaaatgaaaatattatcgacagtagtgatgttacggattatccaaaggcttatccaaagtttgctattattggtacaggtattcgtttaccaggtgatattaataataaggatgatttctggaaggtaatgatagagaaaaaagtaattactggtcttactccagaagatcgttgggatcgtgatgaatggtattgtaagacagaaaagcccggaacaattcaaactttatatggtggttttatcgagaatgcttttgattttgataataaattcttttctatttcccaaaaagaagcattagatgctactccggaacaaagatggctttgtgaattaactgttgaaaccattgaagatgccaatattaatattgataaatttaaaggaagtaatactggtgtttttgttggtacttcaggtatagattatggtagttacgttttttcagtaccagaaaaaattacaaaatatacttatagtggaattgaaccttctattcatgccaatcgtgtttcttatcttttcgatcttcacggtccatcattatccaccaataccgcttgctcttcttcattgactgctttatccattgcttgtaattctatggccgctggtgattgtgaaatggctattgtcgctggtactaatttcttccaagctccagcaaatggtgttgcctattctcaacttcgtgttgtatcaaagaaaggcgcttgtcgtccattcgatagtggtgctgatggttatgctcgtttagaaggtgctggtatggttttattaaaaccttatgaaaaggccatccgagataataataaaatttatgctactattttaagtactgcttgtaatgaagatggaaaaactgcttctttaactactccatcttccaaagcccaatataaattaatgaagcgtgtttatgaaaagggtcatattgatccatgtactattgattttattgaagctcatggtactggtactgctgttggtgatccaattgaggctagttccattggtgaagcttatggtaaaattaataaagccaatggaaatccagccatcccagtcggatccgttaaaggtaatgttggtcatggt

SEQ ID NO: 26337 - DNA, 1515 bp, Piromyces finnis
  POLYKETIDE SYNTHASE-RELATED
tgaatgtattggtactattgttcatacaggttctaatgttaaaaactttaaaaaaggcgatgttgtctttggtttgaatcttcaggcaaatgatattccatcaacatacgttaagattcatcaagatttggttttcccagtgaatactatggatatggataagcaaaataaccttctttcatctgtttatgcttacaccgtagctatttatcttttaaatgaaattccaacaggtgaatctgtccttatttcaacggatgcaagtgatttaatgcaagctttagctaccattgctcaacagaaaggtattaacctctttatcgatgatacatcttcaaaatacagtaaagctaatagcaatgccttcaagaatattaaagcccaaatgataaatactcgtcaagcatccgaatacgttcgtcttgtcaaacaacatacgaatggtgaaggtgttggtgttattattgacattaatgtaaagtttgataaggaaaacacactagaaaaatgtttaagaattgatggtgaatatatcaaggttggaaatattgatcaaagtaccaagaaaagaactacccataagatagttcaaatgagtcattttaaggataatgtcattactccagtagtccgtcaagcagtggaaatgattattcatggtaaggttgaagccattgatcttaagacatatccagtttctaaaataaattctgctacacttgaaatattaagtggtcgtcttcaaggtaaatcttgtcttgaaatgtgtaagaagggtgaagatgacatagaatttgagtgccttccaagtcgtgtctttaaggaaaataaatcctatttgattaccggtgcttttggtggtattggcttaaaagttggtctttggatgcaacttcgtggtgctcgtcatattgtattaacaacatcgtctgatccagagagtaaatataagcatccaattgttaatgctttacgtcaaaaaggtgttcatgtcaccattactaaatgtgatatttcaaagtatgatgaagttgaaaagcttttcatggaaaccacaccagcaatcgatggtgttttccatttcgctaataaattcggtccaaagcttatcagggattctagcctagatagttttaatacagcatttgaaccaaaagcaagaggtgcattaaatcttcataaaataagtcaaaaaggattctcactttcttcctttgttcttttctcctctgttttagatattcttggtaattctggtcaaatggcatatggtgctgcaaattcttaccttaataatcttatttattatagaagacgtaaaggtctttctggtcaatgcttctcattaccagccatgaaaggttctggttacctttcccaatggaaccaaatcactcaatctcgtgaattttctgaagttatagaattccttgattcagaagacttacctgacattcttgactttttccttcgagatgatgttgatccatgccttcaattgctttctggcattca

SEQ ID NO: 26338 - DNA, 2661 bp, Piromyces finnis
  POLYKETIDE SYNTHASE-RELATED
tgtcattggtattggttgtcatttcccagaaggtattgaatcaaaggaatccttctggaaaatgttggaagatggtaaatgcattaccaaagatattccaaaggaaagatgggataaagatgaatggtattctaaagaacctgttcaaggaaccattcaaaccaaacgtggtgccttcttagagaatccatatcttttcgataacaaatatttttacatctccatgccagaagctaaggaaatgtcaccagaacaacgctggctcttagagttaaccgttgaaactcttgaagatgcaaatatcaaaccagaaactttaaagggttctcgtactggtgtttttattggatcatcaggtattgattacttagttacccaaatttctcatgctaatgatattaattcacacagtcctactggttttgagctttccattttagccaatcgtttgtcttatgtctttgatttccaaggaccatctataagttgtaatactgcatgttcatcagcattctctgctttaaacatcggtttaaatgctatgattactgatgattgtgaaatggctattgttgctggttcaaactttatgagttgcccaggtagttttgtagcttattctcaacttcgtgttgtttctaaagatggttcatgtaaaccatttgatgaaaaagctgatggttatgcaaagttagaaggtgctggtatgatattagttaaaccttatgagaaagctgttcgtgatggtgataagatttattgtgcaattgttggttgtggtagtaatgaagacggtcgttccccatctcttactatgccttcctatgaagcacaatataagttattaactcatgtttgtgagaaatctggtattaatccaactcaaattgattatgttgaagcccatggtactggtacaaaggttggtgatccaattgaatcccatgctataggtgatgcttatggtagaggtaagggtattcgtggtccaaatgacccacctgtattagttagttctgtaaagggtaatacaggtcatggtgaaaattctagtggtattgtaagcattattaagacttcaatgatgctttataaacgtaaattagtaccaacggccgcctatcatcgtcttaatcaagctattgatgccgaaaaattaggtattaaagtttgtgaaaaattagaagattggaatacccctcatatcttacatgctgcagtaaactcatttggttttggtggtgccaacacaaatgctttattagaagaagttaaacatttgaatccacaagatattcaacttaatatttctcaaggcaaaccaattgttgccaagatttctggttacaatgaaaaattagttatgcaacaattagaagaatggcgtaaggttccaatggaaactcttcttccacaactttatatttcaaatacttgtagagaagacagtcattatcgtatttcctttattttagatgatccagcaaaattctatgactatgttgatattattttaaagggtcgtaatcatatcaatgttatcaagtataataataagatttctgttaaaccaaaggtagccttcaccttctcaggtcaaggtactcaatatccagaaatgggtcttcaactttacaatatgaacccatatttcgcaagtattattgattactgcaattctatccatacccaaatttctaaaaaagatcttttaaaggagactggcttatttggtaagggtcctgtaaatgaagaaaaacttttagatccacagtattcattcccagctattggaataatagaattagctctagttgaactatggaaacgttatggtgttgaaccagctcttgtctttggtcatagtatgggtgaagttgctgctgcttatgctgctggtattttaactattgaggatgctattcttttactttataactatggacaaataagcgaaaatgtagttgatgctggtgcaaagagtggtatgttagctattggttgtagctctgaagaagctcaatcaatttacttaaagggtaaagataaggtttttattgcttcaattaatagtccaaaagatattactcttggtggtgatcttgaacaacttaatgaaattatggctgaagccaggaagaacaatgtcttttctgttatgttaaaggtaaagaaggctttccatacttcctacattattacagctaaggacaaattccttcaaagtatccaaggtattggtaatagagttaaagcaccaaagattccattcatatcctctacctatggcagagaatatcaaggtccatttgatgaagaatattggtggacaaatatcattagtccagtcaactttagccaagcaaccaagattgctcgttcaaagatcgataaagttttagaaattggttccacaccagttttaggtatctatatgagtaacgatttccatcaggataatatcttctataccctttctcgtaagttaaataataataatagcttaagtagaaatatagcaaatatgtatgctaaaaaatgtttcaacaactttaattggagacaatattatattgatttcatggatggtattgatggtgaaactttggataagattcgtagtatcgattatccaatgccaaaacatgtatgggatcaccg

SEQ ID NO: 26339 - DNA, 6102 bp, Piromyces finnis
  POLYKETIDE SYNTHASE-RELATED
tgtcattggtgttggttgtcgtttcccaggtaatattaaatcaaaggaagatttctgggaaatgcttactactggaagatgtcttacctctgaaactccaaaggaccgttgggattctgctgaatggtataacaaagagccaaagagaggtactgttcaaactactagaggtgcatttatggaagatgccttctactttgataataagtatttctcaatttctcaaaatgaagctaaggaaatgtcaccagaacaacgctggttattagaattagctgttgaaacctttgaagatgctaacattaatccaaagaaattaaagggttctagaactggtgtctttgtcggttcttccggtatggatttcgtagcagctcaaatttctcatgctaatgatttaactcaacactctgctactggtcttgaactttctattcttgccaaccgtatctcatactactttgatttaaatggtccatctatttgtactaacactgcatgctctgcttctatgactgccttaaatcttgctattaattccatgattactgatgattgtgatgcagctcttattgctggtactaatttattattcactccaggtagttgtgttgcatactctcaacttcgtgttgtctctgttgatggttcttgcaaaccatttgataagagggctgatggttattctcgtgttgaaggtgctggtatgttattgattaagccatatgaaaaggctgtaagagatggtgataaaatttattgtgctattttaggtagtagtactaatgaagatggtcataccccatctctcactatgccatcctatgattctcaatgtaaattattaactcatgtttgtgaaaaattcgacattgatccagcctcaattgattatgttgaagctcacggtactggtactgcagttggtgatccaattgaagctcgttcaataggttatgcctatggacgcagagttcgtgaaggtaaacaaattaagactactcgcccaggtgagactgaggaaattcttgatcaaccaacctatccattgatcattggatctagtaagggtaatactggtcatggtgaatattctagtggtattattggtatgattaaggctgttttaatgcttcaccatcgtactatggttccaactattgctcatgaggaaatgaacccagccattgatgctgaaggtttaggtattaaggttgctacaaagttagaaccatggactactccgcacactttacgtattgctgttaactcttttggttttggtggttcaaatggtaatgccatttttgaagaagttgttaatgaaaagccagaagatttagttatgaatatcaaagatgctaagaatccagttgtagctaccttctctgcttacgatgaaaagactcttcaacaacttttaaagaagtggaatactgaaattccaaatgaagatttattacaagaactctttatttcttctcaatgtcgtgaatatgaaagtatgcgttctgctatgatatttagttctattgacgaagctagatctcttattcaagaaatggcagaaggtgatgttgaaaagttcaagagacacgaaaagatttacatgaagcgtgttaaaatcagtgaaaaaccaggaattaactttgctttctctggtcaaggttctcaatttataaatatgggtagacgtatgtatcaaaccaatgatctctttaagaaggttgtcgattattgtgctgctgttcttgttactattaatggcggtgaagatatctttgaaaagtatagcatctttaagggagatgttgctcaaattagcgaaaccgatctttctcttccacaattctctgttcttgctattggtattgctcaaattgctttaattgaagtttggaagtctatgggtgttacaccaaaggctgtctatggtcatagtatgggtgaagttgctgctgcttatgctgctggtgttcttactatcgatgatgctgtcttattattatacatgcgtggtcatattcttgctcaattagatggtactggtaagggtatgttagctcttggatgctcagttgaaaatgctcaacgcttcatggctaataagccaaatgttttcatttctgctgttaacagtgctaattctattactttagccggggatcttgaacaaattaatgctgttgcaagagaagctcaagctgaaaaactttttgctgttgtattaaaggttaagcaagctttccattctccatacgttgaaggtgctgaaaaggctttcaaggaaagtattagaggcattggtgaacgtactaaagctccaaattgtaagtttgtttctgcttgttttggtcaagaatatgaaggtccattcgatgaaaattactggtgggctaatattcgtaatccagttagtttccatgctgctgcttctattgctactcaattctctaagcgtgttttagaaattggtgctcatccagttcttggtatgtatcttaaggaaatctatggtaaggataacgtctacttctccttatctcgtaagatggatgacgttgatagtatgtgccgtactactgctaacttattcattgaaaatgctgttgatatccttgactacactcaaatttgggatggtaaggttgatctttacaatgcaaagtctggcgttgctgttccattaaagaagttacgttctattaattatgttcttccaaagcatgtatggaaccgtaaagaaattagaaaggtttacactgactatattggtaccaatccaattcatgaaatttacaccactcgtgaaaatgttcttaaggatatgggcgttactgaagatgatcttaagcttcttaagagcattaaggaaggtaaggctactgtcccaacctcagtaaagccaaaacctgtatctgctgcagctccaaagaccacctttattccaagtcaatctaacattgtctatagttctggtaatcaatggaactttgaaaatcatcgttaccttcaagaccatgttgttaacaaaaagattgttcttccagcttgtggctctgttagtcgtgcctttagtggttatgccaatgctcatccattaatgatggctcaaaaggctatcatttctcttgaagatttgaaattcgatcgtatgggtatctttgataaggctattgactttaacactgttactggtccaatgccactcacctttaaggaagaaggcagtaccaatacttataaggttatatttaatgaagatactgaagtttcttccggtaagtttaacgatgcagatgaaactgaagccttaaagcaaattccatctgctgattactttatcaaacaatgttcttctgtcagtggtggacaaggcgttactccagacatgttctacaaccgtactcatgaaattggtttagactatggtaaggaattccgtttatataaggctatacgttctggtaagaatgttgcttatggtaaacttgctgttagtaaggaacaccaaaagatggtttgtcatccagctgtcttagataactgtattcagattgtttttgcttctggtgttgcctctggtgattgtcaagcccttccagttggtatgaagaaggttgttttaagtcaaggtggtcatttcccagaaggaactcttattgttgccactgaattagttaaacaagatattaaggaatgtgtctctaatgtttacatttatgatgaaaacaagaatatatttggttttgttgaaggtttaactatgtccttccgtcgtggtagagctgaaaaggctattgattggattcatctcttaggttatgaagaaaaggctcctacctctactgaaaaattaccagttgcttgccgtaatgttattgttatgtgtactgaaagccaacaaaatgaagctaacgctcttgctactcatattggtagtgtcattgctggtttacaaaatatttgggtattaccaaataaccatgttgaaaatattcaacaaatggttgaaagtgcaatgattaaaccaaaagaaacttttgttattgatgcaagctttattgatagcccagaaattgatcgtgccttcatgactcttaaaactatggttaactatgaaatcccagttttatttgctgcttcaaagtacatcaaggatgaatctgctaactctcgtgctattgctactagtaaagctgttattggtatggttcgtgctgctcgtgctgaatgccaagttccattatttactgctcacgctaatcgttttgaagatttatacttggctgttttacgtagtgatctcactatggatgatccagaagttgaaattattgatggtaaggttcaatgtgttcgtttcatgaagttagacaaggttccagatgttaagtctaccaatgttaagttagaaaagagtgctaatggtcaaatcggtcaaatgaagtttaccgaatgtatcggtcttccaaagtataatgatgaccaaattgttataaagaccaagggtgtttctatgcaattcaaggatatcatgactgccatggataccttggttggttttgatgactatgaaccaggtatggaatgtattggtcgtgttgtagctattggtaagaatgttgccagtgatccaaagaatgtattacaaattggtgatccagtcgttgcttttgcccacaagtatggtcatcttcttcgtacctatggtgtagctgatccactttccgttcaaaagattccagaaagtatgtacaaggttgaatatgctggtatctttattgttttcattactgcttactacagtttacacgttcgtgctggtggtattaaaccaggtcaaaccattttaattcatgctgctgctggaggtgttggtcaagctgctgttaagttatgtcaactctggggtgctaacattattgcctcagcatcagcttctaaacaacaattccttcgtgacacctatggtattgaacatgtcaccaactctcgtgatccagaacaattctacagtgatgttatgaaatggaccaatggtaagggtgttgactttgtcttaaactctctctctggaaagagtctccgtatgggtattaaatgcttaaagaacggtggtaagtttgttgaaattggaaaaactgatatcttgaatgatagtcaattaggtttacattgtctccttaacaatatttccttcatttcttctcacattgaccttctcaacaaccaacaaatgagtttctacaagaacattatctttgatatgtttaaaaccggaaaacttactccaattccagccaagatcttctcagctaacaaatataaagaagccttcttctatcttgctagtggtagaaatgttggtaaaacttgcattgaattccaagacaatgttgccattgactgtaatccagtaactattgtcgatccaaacttaacctatcttgttactggtgcctttggtggtgttggtttaagagttgttctttggttagttagccgtggtgcaaagaaccttttattaactactagtggatcagttgaaaagcaatatgaacaaccaattattcgttctttaattgaaaagggagtcaatgttatgattaagacctgtgatatcactgattacaacaatgttcaacaattattccaacaaactcaaccaagagttgctggtgtcttccatttagctaatcgttttgctccaggtttaattagtacttctgaccttgctttacttcgtaagggctttaatgctaaggctgaaggtgcttggaacttacacaaggttactgctcaaaagcaacatcaagttcaactctttgttgtcttttcttctattcttgacgttttaggtaaccgtggtcaaaccgcctatggtgctgctaatgccttcttaagttctatcattgatcaccgtagagaaaatggtctttctggtaattgtatcgctcttccagctatgcgtggttctggttacttggctaaatggaaccaaactaagcaatctaaggaatttgaacaattaattgcccttcttgataccgatgaattagtcaatgttatggatggtttaattcgttacgatcttccagc

SEQ ID NO: 26340 - DNA, 2094 bp, Piromyces finnis
  POLYKETIDE SYNTHASE-RELATED
caacagtaacaaatcaaatagtattgctattattggtatgggtttacgtcttccaggtgctatcaatagtgacaagtctttatggtctactttagttaaaggcagagactgtattacagctattccaaaggatagaaaattacatgaaaactatgttgataagcaaagtagtgaattaaacatgggtgaacataatgttaagcgttgtggctactatgactcccgttcaagtggtaaaaagatttctcaattcgatgcagaatttttcaattgccttccggatgaagctattggtcttgatccaaagcatcgttggatcttagaaacaagttgggaagctcttgaaaatgctggtatttcacctgaatcccttgaaaataccgatacaggtgtttttgttggtattggtgatcaacaagaacatgtcaagtttatgcaagaatgtcaaaaggaaaaagttgttgcccatcacaatagtaatccatcagctattgctggacgtttaagttacttttacaaactttatggtccatctgttactgttgatacagcttgttccactggtgcaacagctcttcatactgcctgtcgttctatgattttcggtgattgtaacctttccattgtgaccgcctccaaattcttattctattcagaagaatttgaaatgacaagtaaggcaagaatgacttctccatctggtcgttgtgctacttttgataagaatgctgatggttatgtcccagctgaaggttgtgtaacctttatattaaaacgtttagaagatgctgaacgtgataaggatcatattcttggtgtaattcttggtactagtagtggtcaaagtggtttccgtcaatccattagtgttccttcatcagaaggtcaagctcgtaatattgaacgtgctatggcagttgctggtgttcaaccttctgacatatcttacattgaagcacatggtactggtacaccatatggggatgccattgaaattcaaggtattaatcaagtttatgctggaagccacacctcggaacatccattagtcatcggtagtatcaagacaaatattggacatacagctgaaactgctggtttagctagcattgccaaggttttattagctatgaagaataaaactattccaagaaatcttcatttcaagaaccttaatcctgaaattgacttgggagttgttccactctccgtcccaacacataatgtgaaatgggaaactgttgatggtaaaccaagaacagctttggtatcttcttatggtttacaaggtagtgctgttaatattattctacaagaatacgttccaccacaaaatagggaagttgaagatgttaccgataagtctgttgaaaaacaattaaacagtgatatcattggtatcaaagaaaaatctttgttaaccattagtgccaaagataagatagctttacttgatttatgtaataaatatagtaatattttagattccatgaataatgatgaaagtatccaaaatctttgttataccagtaatgttggtcgtcaacactttgaaaatcgtatagtggctgttggtgaagacgttgaaacattatcagacaatcttcaaaaagtcatggataaaatatttgatgatgaagtcaaggttgaatcttttggtaagaagagagttttcaagaatactggtatgtccttcactagttactaccaacaacctaaccttatcactgatgaaatgtataaattttcttgctatctctaccgtactcaacctgtctatgctaaagccttagaagaatgtgataagattatcactgagttaagtaactttaagattttattggtcaatttggttatttgtatgggcgaattgatacaaccagaattattacaagaatacaaaaagcaagtagatgaagatccatgtatggctcaattcattgctctttccatgaactatgctttaataaaacttttagaacatttatctatttcaccaaatcttgttgtgggttataaatttggtgaaattacagctgctcttgcctgtggtaagatttctttgagaaatgctttccttattattcattacat

SEQ ID NO: 26341 - DNA, 504 bp, Piromyces finnis
  POLYKETIDE SYNTHASE-RELATED
agttcaaatgagtcattttaaggataatgtcattactccagtagtccgtcaagcagtggaaatgattattcatggtaaggttgaagccattgatcttaagacatatccagtttctaaaataaattctgctacacttgaaatattaagtggtcgtcttcaaggtaaatcttgtcttgaaatgtgtaagaagggtgaagatgacatagaatttgagtgccttccaagtcgtgtctttaaggaaaataaatcctatttgattaccggtgcttttggtggtattggcttaaaagttggtctttggatgcgacttcgtggtgctcgtcatattgtattaacaacatcgtctgatccagagagtaaatataagcatccaattgttaatgctttacgtcaaaaaggtgttcatgtcaccattactaaatgtgatatttcaaagtatgatgaagttgaaaagcttttcatggaaaccacaccagcaatcgatggtgttttccatttcgctaa

SEQ ID NO: 26342 - DNA, 225 bp, Neocallimastix californiae
  Polysac_deacetylase
aaacgccgaaattggtacttgggctggcttccgtaaaggtgcagcttcatttacttttgatgatggtgctccaagtcacgtaagcgatggtgccccagtatttgaaaagtatggctatagagctactttctttttggtatacaactggaatccaaactggagtggtttccaatccttggccaacaagggtcacgaaattggtagtcacagtaatagccacggtca

SEQ ID NO: 26343 - DNA, 252 bp, Neocallimastix californiae
  Polysac_deacetylase
acaaaacgctgaaattggtacttgggcaggtttccgtaagggtgcagcttcatttacttttgatgatggtgctccaagtcaagtcagcgattgtggtccagtattcgacaagtacggctacaaaggtactttcaacttggtttacaactggaaccccaactggagcggtttccaaagtttggccgacagcggtcacgaaattgctagtcacagtaacagtcacggaaataatatgagtggtgaagaagcctc

SEQ ID NO: 26344 - DNA, 252 bp, Anaeromyces robustus; identical to SEQ ID NO: 26343
  Polysac_deacetylase

SEQ ID NO: 26345 - DNA, 510 bp, Anaeromyces robustus
  Polysac_deacetylase
attctacactcaatgtaataatccaaaacattgggctatgacttatgatgatggaccaaccgaatttgctgatgcaattttagatcttttaaaggaaaaaggtattaaagcaacattcttcattgttggacatatgtatatggataataatagttctgattggtctagaattattaagagaatggatagtgaaggtcatattgttggtaaccatacttatgatcaccaagatttaactggactttcatcagatcaaattattagtcaaatgaaacaagttgaagatcgtatcttcaaaattattggtaagagaccagcatttatgcgtccaccatatggttcaggtaatggtaaccaaaatgttatgaatgcacttcaacaagctggttacacagctgctattaattggaatgttgatccacaagattacagtaatggtggtgatgctaattatgctagacaagttattaatcaagctaaaggtcaaccaatcattaccttaaatcactt

SEQ ID NO: 26346 - DNA, 219 bp, Neocallimastix californiae
  Polysacc_deac_1
taaaggtgcagcttcatttacttttgatgatggtgctccaagtcacgtaagcgatggtgccccagtatttgaaaagtatggctatagagctactttctttttggtatacaactggaatccaaactggagtggtttccaatccttggccaacaagggtcacgaaattggtagtcacagtaatagccacggtcaaaacatgagtggtgaagaagcttcttc

SEQ ID NO: 26347 - DNA, 216 bp, Neocallimastix californiae
  Polysacc_deac_1
taagggtgcagcttcatttacttttgatgatggtgctccaagtcaagtcagcgattgtggtccagtattcgacaagtacggctacaaaggtactttcaacttggtttacaactggaaccccaactggagcggtttccaaagtttggccgacagcggtcacgaaattgctagtcacagtaacagtcacggaaataatatgagtggtgaagaagcctc

SEQ ID NO: 26348 - DNA, 216 bp, Anaeromyces robustus; identical to SEQ ID NO: 26347
  Polysacc_deac_1

SEQ ID NO: 26349 - DNA, 384 bp, Anaeromyces robustus
  Polysacc_deac_1
taataatccaaaacattgggctatgacttatgatgatggaccaaccgaatttgctgatgcaattttagatcttttaaaggaaaaaggtattaaagcaacattcttcattgttggacatatgtatatggataataatagttctgattggtctagaattattaagagaatggatagtgaaggtcatattgttggtaaccatacttatgatcaccaagatttaactggactttcatcagatcaaattattagtcaaatgaaacaagttgaagatcgtatcttcaaaattattggtaagagaccagcatttatgcgtccaccatatggttcaggtaatggtaaccaaaatgttatgaatgcacttcaacaagctggttacacagctgc

SEQ ID NO: 26350 - DNA, 189 bp, Neocallimastix californiae
  PP-binding
gaaaaaggttcttcaatacggtgaaaatgatgaaattgatccttatcaatccttatctgaattaggtattgattccattatgatgatggaattacgtaccattttaaagaatgttacaggaattaatattcctttggtagtattctccactcaaaatatttgtctttaccgtcttgtagaatatgtcaa

SEQ ID NO: 26351 - DNA, 198 bp, Neocallimastix californiae
  PP-binding
aaaggaggaagttcgtagaatgttaatgtataatgaaaatgatgaattagatatcttccaacctctctctgaattaggtattgattctattatgatgatggaacttcgtcaaattattaaggctgtaactaatattactgttccactttctattattaccacgccaaacttaacactctctaagatctttgaatatct

SEQ ID NO: 26352 - DNA, 195 bp, Neocallimastix californiae
  PP-binding
atcaattaaggaaattattccttctactccagaatttaataaatttaatccagatgcgcccttcaccgtatatggtattgattccctatcggttatcaagttaaccaacgtcttgtcaagaaaattcaataaaaagtattctcctgctattctttttacctatggtacgacggcttctcttgccaaatatttaaa

SEQ ID NO: 26353 - DNA, 195 bp, Neocallimastix californiae
  PP-binding
tattacagaaaaattacaaagtatgttaggattaattgatgaagaaattgatgttactattccacttcgtgtctatggtttagattctttaacagctatggaattaaccaaatggattgaaagtgaaatgaatattgaattcaatcaaagtcaattattaggtgatgatattactactgaagatttaattaatat

SEQ ID NO: 26354 - DNA, 201 bp, Neocallimastix californiae
  PP-binding
agtagttgaaaaattacaagatttattaggtttagttgatgaaaatattgatactaatgtaccattgcaagtttatggtttagattctttaacttcaatggaaattgttaaatgggttgagaatgataaaaaagtagaactaccacaatcagctttattaagtagtgaaattactactgaagaacttgttaatatgattgc

SEQ ID NO: 26355 - DNA, 192 bp, Neocallimastix californiae
  PP-binding
aatatgtgatagattacaaaatatgttaggtttagtagatgaaaaaattgatccagctattccacttcgtgtttatggtttagattccttaactactatggaattaaccaattggattcaaagtgaattaaaggttacattaccacaaagtcaattattaagtgatgagataactacaaatgaattagttag

SEQ ID NO: 26356 - DNA, 195 bp, Neocallimastix californiae
  PP-binding
tattacagaaaaattacaaagtatgttaggattaattgatgaagaaattgatgttactattccacttcgtgtctatggtttagattctttaacagctatggaattaaccaaatggattgaaagtgaaatgaatattgaattcagtcaaagtcaattattaggtgatgatattactactgaagatttaattaatat

SEQ ID NO: 26357 - DNA, 195 bp, Neocallimastix californiae; identical to SEQ ID NO: 26356
  PP-binding

SEQ ID NO: 26358 - DNA, 195 bp, Neocallimastix californiae; identical to SEQ ID NO: 26356
  PP-binding

SEQ ID NO: 26359 - DNA, 195 bp, Neocallimastix californiae; identical to SEQ ID NO: 26356
  PP-binding

SEQ ID NO: 26360 - DNA, 192 bp, Neocallimastix californiae
  PP-binding
tactgataaattacaaagtatgttaggattaattgatgaagaaattgatgttactattccacttcgtgtctatggtttagattctttaacagctatggaattaaccaaatggattgaaagtgaaatgaatattgaattcagtcaaagtcaattattaggtgatgatattactactgaagatttaattaatat

SEQ ID NO: 26361 - DNA, 195 bp, Neocallimastix californiae
  PP-binding
tattacagaaaaattacaaagtatgttaggattaattgatgaagaaattgatgttactattccacttcgtgtctatggtttagattctttaacagctatggaattaaccaaatggattgaaagcgaaatgaatattgaattcagtcaaagtcaattattaggtgatgatattactactgaagatttaattaatat

SEQ ID NO: 26362 - DNA, 201 bp, Neocallimastix californiae
  PP-binding
atatgagtcaataaaggaaattattccttcaactccagagtttgaaaaatttgatccagaatctccatttactgtttatagtatcgattctcttgctattattaaattaaccaatattttatcaagaaagttcaatgagagatactctccagctattctttttaactatggtaccaccagtcttcttgctcaatatataac

SEQ ID NO: 26363 - DNA, 198 bp, Neocallimastix californiae
  PP-binding
tcaatccattaaagaaattattccttccacaccagattttgaacagttcgttcctgaaaagtcctttaccatgtatggtatcgattctttaactactgtcaagctaactaaccttctctctcgcaaattaaagaaaaactactctccttccattattttcaactatgcctctccattacttttagctaaatatttagc

SEQ ID NO: 26364 - DNA, 195 bp, Neocallimastix californiae
  PP-binding
tattactgaaaaattacaaagtatgttgggtttaattgatgaagaaattgatgttaccattccacttcgtgtctatggtttagattctttaactgctatggaattaaccaaatggattgaaagtgaaatgaatattgaattcagtcaaagtcaattattaggagatgatattactaccgaagatttaattaatgt

SEQ ID NO: 26365 - DNA, 195 bp, Neocallimastix californiae
  PP-binding
tattactgaaaaattacaaagcatgttaggtttaattgatgaagaaattgatgttaccattccacttcgtgtctatggtttagattctttaactgctatggaattaaccaaatggatagaaagtgaaatgaatattgaattcagtcaaagtcaattattaggagatgatattactactgaagatttaattaatgt

SEQ ID NO: 26366 - DNA, 195 bp, Neocallimastix californiae; identical to SEQ ID NO: 26365
  PP-binding

SEQ ID NO: 26367 - DNA, 186 bp, Neocallimastix californiae
  PP-binding
attaaagagaattcttcaatacggtgaaaatgatgaaattgatccttaccaatccttaaccgaattaggtattgattcccttatgatgatggaattccgtactatcctaaagaatgttactaccgtcaatattccattagtcgtcttctccacccaaaatatttgtctcttccgtcttgtcgagta

SEQ ID NO: 26368 - DNA, 201 bp, Neocallimastix californiae
  PP-binding
ttattcttgcatggctgagattattccatctacggttcctttcgatgaatttaacatttatgatactttcacttcctcaggatttaactccattaattccgtaaagttaataaaattattaaatagcaaattaaagacaaactattccactgtcatgctctttaattttaattctccctatgaattagcgagagcattaat

SEQ ID NO: 26369 - DNA, 201 bp, Neocallimastix californiae; identical to SEQ ID NO: 26368
  PP-binding

SEQ ID NO: 26370 - DNA, 189 bp, Neocallimastix californiae
  PP-binding
tataactgaaattataccatctacagttcctttcgatgaatttaatattcatgacacttttacttcctcaggattcaactcaatcaattcagttaagctaataaaactattaaatagtaaattaaagacaaaatattctactgtcatgctattcaattataatacaccttatgaattagctaaagcatt

SEQ ID NO: 26371 - DNA, 201 bp, Anaeromyces robustus
  PP-binding
ttatcaatctattaaagaaattattccatctactccttcttatgaagaatttaatccagaaagaccatttaatctttatggtattgattcacttgctactgttaaattaaccaatgttttatcaagaaaaatgggaaaacgttattcaccagctattcttttcaattatggtaattctcttgaattagcaaaattcataac

SEQ ID NO: 26372 - DNA, 201 bp, Anaeromyces robustus
  PP-binding
aaagagagaagttcgtagaatgttaatgtataatgataatgatgaattagatgaattacaaccactttctgaattaggtttagattctattatgatgatggaattccgtcaaattattaaagctgttactaacattgttgtaccactttccattattacttcaccaaacttaaaccttaaagaaattatacaattccttga

SEQ ID NO: 26373 - DNA, 189 bp, Anaeromyces robustus
  PP-binding
aaagagaattcttcaatatagtgaaaatgatgaaattgatccatatcaatctttaacagaattaggtattgattctattatgatgatggaattacgtactattttaagaactgctacaggtgtaaatattccattagttgttttctcaacacaaaatatttgtctttcacgtcttgtagattatgttaa

SEQ ID NO: 26374 - DNA, 186 bp, Anaeromyces robustus
  PP-binding
agaaattattccttctactcctgaatttgaagattttaatccagaaagaccatttaatttttatggtattgattctcttgctactattaaattaactaatattatttcaagaaaattaggtaaacgttatactccagctgttctttttaattatggtaatgctcttgaacttgctaaatttgtaac

SEQ ID NO: 26375 - DNA, 195 bp, Anaeromyces robustus
  PP-binding
atgtaatgtatatagtaaaacattaaatattgatgaaagtaaaattggaaaaatgagcgatttctttgaattaggaggtgatagtttaaacgctataagaattatatcaatgattgaaaaggaattgaatataaaactctatataaaagatatattatcgcatcctttagtaagtgaaattagcgaatatattga

SEQ ID NO: 26376 - DNA, 195 bp, Anaeromyces robustus
  PP-binding
ttgcaaaatttattcgaatgtatttaatattaacgaaaatagtgttggattaatgaatgaattttatgaacttggaggtgacagtttaattgttattagtattttatcattaattgaaaaagaattaaagataaaattaaatgttaaagatattctttcacatcctttaattaaagatttatgtgattatataga

SEQ ID NO: 26377 - DNA, 186 bp, Anaeromyces robustus
  PP-binding
tgtagaaattattccatctacagtaccatttaatgaatttaatgcagatgaagccttttcttcatttggattaaattcaattaattccattaaattaattaaattattaaatagtaaattaaaaacaaattattctactgttatgcttttcaattataattctccaacagaattagctaaagcttt

SEQ ID NO: 26378 - DNA, 186 bp, Piromyces finnis
  PP-binding
gaatgttctccaatacggtgaaaatgatgaaattgatccataccaatctttaactgaattaggtattgactctatcatgatgatggaattacgtactattatgagaactgccactggtatcaacattccattagttgttttctccactcaaaacatttgcctttaccgtcttgtagaatatgttaa

SEQ ID NO: 26379 - DNA, 195 bp, Piromyces finnis
  PP-binding
gtcaattaaagaaattattccttcaactcctgacttcgaattattcaatcctgaaaatcctttcaatatttatggtattgattcactctctactatcaaattaactaatatattatcaagaaaattgaataaatacttctctcctgccatcctcttcaactacggtaatacttatgctctcgctaaattcattac

SEQ ID NO: 26380 - DNA, 153 bp, Piromyces finnis
  PP-binding
aaagaaagaaattcgtagaatgttaatgtacaatgaagatgatgaaattgacgaaatgcaaccactttctgaattaggtatggattctattatgatgatggaattccgccaagttattaaagctgtcactgatattatgattccactttctat

SEQ ID NO: 26381 - DNA, 192 bp, Piromyces finnis
  PP-binding
ctctgaaaagttacaaagtatgttaggtttaattgatgaagaaattgatgttactattccacttcgtgtctacggtttagattccttaactgctatggaattaaccaaatggattgaaagtgaaatgaacattgaattcagtcaaagtcaattattaggagatgatattactactgaagatttaattaatgt

SEQ ID NO: 26382 - DNA, 192 bp, Piromyces finnis; identical to SEQ ID NO: 26381
  PP-binding

SEQ ID NO: 26383 - DNA, 192 bp, Piromyces finnis; identical to SEQ ID NO: 26381
  PP-binding

SEQ ID NO: 26384 - DNA, 192 bp, Piromyces finnis; identical to SEQ ID NO: 26381
  PP-binding

SEQ ID NO: 26385 - DNA, 192 bp, Piromyces finnis; identical to SEQ ID NO: 26381
  PP-binding

SEQ ID NO: 26386 - DNA, 192 bp, Piromyces finnis; identical to SEQ ID NO: 26381
  PP-binding

SEQ ID NO: 26387 - DNA, 192 bp, Piromyces finnis; identical to SEQ ID NO: 26381
  PP-binding

SEQ ID NO: 26388 - DNA, 201 bp, Piromyces finnis
  PP-binding
agttattaccaaattacaagatttattaggattagtagatgaagaaatagatgttaacgttccattacaagtttatggtttagattctttaacttcaatggaaattgttaaatggattgaaaatgataagaatgttgatcttccacaaactgcattattaaatagtgaaatcacaacagaagaacttattaatatgattgc

SEQ ID NO: 26389 - DNA, 201 bp, Piromyces finnis
  PP-binding
ttatcaatccattaaagaaattataccatctactccagattttgatcaatttgatccagaaatgtcattcactatgtatggtatcgattctctctctaccgttaaattaacaaatattttatcgagaaagttaaagaagaactattctccttctattattttcaattatgcttctccacttttacttgctcaatatttatc

SEQ ID NO: 26390 - DNA, 198 bp, Neocallimastix californiae
  Probable ACP-binding domain of malonyl-CoA ACP transacylase
aggagctatggttagtgttttccaaagtgaagatgtcgtcaaggaagcaattgaagaatttggttatgaagaagaagtttcaattgccgctatcaatggtgtaactcatactgttatttccggttatgaagatgaagttgatgatcttaccgagtatttcaatgaaatgaaggttaagactaaaaagttaaacgttac

SEQ ID NO: 26391 - DNA, 195 bp, Neocallimastix californiae
  Probable ACP-binding domain of malonyl-CoA ACP transacylase
aggtgctatggtttctatcttcactactgaagatgttgtcaaagaagctattgaagaatttgaatttgaaaatgtttccattgctgctattaatggtacaactcaaattgttatttctggtaatgcagatgaagtaaaagaattagaggaatactttattgaacaggatattaaggctaaacaattaaatgttac

SEQ ID NO: 26392 - DNA, 189 bp, Neocallimastix californiae
  Probable ACP-binding domain of malonyl-CoA ACP transacylase
attaattgctttaggttgtggcgtagatgaagctaaaactgaatatataaaggataggaagaaggtctatattgcttccattaatagttacaaggatgttacgcttggtggtgatctcaaccaattggaagagatcatggatcaagcaaaacaaaaaaatgtcttcaccgttatgctaaaggtcaataa

SEQ ID NO: 26393 - DNA, 186 bp, Neocallimastix californiae
  Probable ACP-binding domain of malonyl-CoA ACP transacylase
aggtatgctagctcttggatgttccgttgagcaagctcaatacttcatgaataataagccaaatgttttcatttctgctgttaatagtgctaactctatcactttagccggtgatattagccaaattaatgctatcgctcaagaagctaaggctcaaaacctcttcgctgttgttttaaaggttaa

SEQ ID NO: 26394 - DNA, 198 bp, Neocallimastix californiae
  Probable ACP-binding domain of malonyl-CoA ACP transacylase
tggagctatggtcagtattttccaaaatgaaaaaactgtcaaggaagccattgaagaatttggttacgaagaagaagttgcgattgcggccatcaatggtgtcactcataccgttatctctggttatgaggaggaggtcgatgatattacccaatactttagtgaaatgaacattaagacgaagaagttaaacgttac

SEQ ID NO: 26395 - DNA, 198 bp, Anaeromyces robustus
  Probable ACP-binding domain of malonyl-CoA ACP transacylase
gagtggtatgttagctcttggttgtagtgctgaagaagctaaaactacttatttaaatggtaaagataaaaatagagtttatattgcttctattaatagtgaaaaagatataacacttggaggtgatcttaatcagttagatgctatcatgactcaagctaaaaataataatgttttcacggtaatgttaaaagttaa

SEQ ID NO: 26396 - DNA, 195 bp, Anaeromyces robustus
  Probable ACP-binding domain of malonyl-CoA ACP transacylase
aggagctatggtttcaattttcactactgaaagtgctgtcaaagaagctattgaagaatttgaatttgaaaatgtttctattgctgctattaatggtactactcaaactgttatctctggtaatgctgatgaagttaaagaattagaagaatatttcattgaacaagaaattaaggctaaaccattaaatgttac

SEQ ID NO: 26397 - DNA, 198 bp, Anaeromyces robustus
  Probable ACP-binding domain of malonyl-CoA ACP transacylase
aggtactatggttagtatttttgaaaaggaagatgttgttaagaaggctattgaagaatttgatactcaagaagaagttgctgttgctgccattaatggtgtagcccacaccgttatatctggttatgaagatgaagttgatgatattactgaatatttcaaacaaatgaatgtcaagactaagaaattaaatgttac

SEQ ID NO: 26398 - DNA, 198 bp, Piromyces finnis
  Probable ACP-binding domain of malonyl-CoA ACP transacylase
aggtactatggttagtgtatttgaaaaggaagatgtcattaaggaagcaattgaagaatttggatatgatgaagaagtttctgttgctgctattaatggtgttactcacactgttatctctggttatgaagatgaagttgacgatatcaccgaatactttagtcaaatgaacattaagaccaaaaaattaaatgttac

SEQ ID NO: 26399 - DNA, 195 bp, Piromyces finnis
  Probable ACP-binding domain of malonyl-CoA ACP transacylase
aggtacaatggtttctgtatttactactcaagatgttgttgaagaagcaattgaagaatttggttttgaaaatgtatctattgctgctatcaatggtaccactcaaattgttatttctggtaatactgatgaagttaaggaattagaagaatacttcacacaacaagaaattaaggctaaacaattaaatgttac

SEQ ID NO: 26400 - DNA, 195 bp, Piromyces finnis; identical to SEQ ID NO: 26399
  Probable ACP-binding domain of malonyl-CoA ACP transacylase

SEQ ID NO: 26401 - DNA, 189 bp, Piromyces finnis
  Probable ACP-binding domain of malonyl-CoA ACP transacylase
tggtatgttagctattggttgtagctctgaagaagctcaatcaatttacttaaagggtaaagataaggtttttattgcttcaattaatagtccaaaagatattactcttggtggtgatcttgaacaacttaatgaaattatggctgaagccaggaagaacaatgtcttttctgttatgttaaaggtaaa

SEQ ID NO: 26402 - DNA, 186 bp, Piromyces finnis
  Probable ACP-binding domain of malonyl-CoA ACP transacylase
gggtatgttagctcttggatgctcagttgaaaatgctcaacgcttcatggctaataagccaaatgttttcatttctgctgttaacagtgctaattctattactttagccggggatcttgaacaaattaatgctgttgcaagagaagctcaagctgaaaaactttttgctgttgtattaaaggttaa

SEQ ID NO: 26403 - DNA, 57 bp, Neocallimastix californiae
  PROKAR_LIPOPROTEIN
gtttaagcaagtcggtattactgctttattagtcgcatcagttagtgctgcctgttg

SEQ ID NO: 26404 - DNA, 63 bp, Neocallimastix californiae
  PROKAR_LIPOPROTEIN
gaagtttattaatttagttgctacttctattttagctacttgtgctttagcttcttcatgtca

SEQ ID NO: 26405 - DNA, 69 bp, Neocallimastix californiae
  PROKAR_LIPOPROTEIN
gaaaagtgctatcgttctttcaactttaactgttttattaagtcattcagcttttgctcaaagctgctg

SEQ ID NO: 26406 - DNA, 69 bp, Neocallimastix californiae
  PROKAR_LIPOPROTEIN
gaagagtactattattattttaacttcaatagttttattaagtcattcagcttttgcacaaagctgctg

SEQ ID NO: 26407 - DNA, 63 bp, Neocallimastix californiae
  PROKAR_LIPOPROTEIN
gaaattcactgctttaattgcatcttctattttgactacctgtgctttagcttcttcatgtca

SEQ ID NO: 26408 - DNA, 90 bp, Neocallimastix californiae
  PROKAR_LIPOPROTEIN
gaaaactactattgctttaactgctgctgctgctcttgccgctaaggtttctgctgcttgctggtctcaaagtttaggttactcatgttg

SEQ ID NO: 26409 - DNA, 57 bp, Neocallimastix californiae
  PROKAR_LIPOPROTEIN
gtataagacaatcggtattgccgctttatttgtagcatcagctagtgctgcatgctg

SEQ ID NO: 26410 - DNA, 63 bp, Neocallimastix californiae
  PROKAR_LIPOPROTEIN
gaaattcttcgttgctttatctgctattgctgctttcgcttcaagcgcttctgcagcttgttt

SEQ ID NO: 26411 - DNA, 57 bp, Anaeromyces robustus; identical to SEQ ID NO: 26409
  PROKAR_LIPOPROTEIN

SEQ ID NO: 26412 - DNA, 63 bp, Anaeromyces robustus; identical to SEQ ID NO: 26410
  PROKAR_LIPOPROTEIN

SEQ ID NO: 26413 - DNA, 63 bp, Anaeromyces robustus
  PROKAR_LIPOPROTEIN
gaaatttattgatattttaccaattttagttgctgcaggttcagctatggcttctgcctgtca

SEQ ID NO: 26414 - DNA, 66 bp, Anaeromyces robustus
  PROKAR_LIPOPROTEIN
gaagagtttatatattctttcaattattattgcattaagtcattcagctttagctcaaagctgctg

SEQ ID NO: 26415 - DNA, 63 bp, Anaeromyces robustus
  PROKAR_LIPOPROTEIN
gaaatttgttaatttattatcttcaactttatttgctttaggagctttagcttcttcttgcca

SEQ ID NO: 26416 - DNA, 57 bp, Anaeromyces robustus
  PROKAR_LIPOPROTEIN
gaattttataaataaagcaataatatttacttttataagtttaattatcggttgtat

SEQ ID NO: 26417 - DNA, 48 bp, Anaeromyces robustus
  PROKAR_LIPOPROTEIN
gaagatcaaaaatattttatctttatattctttatttattgcttgtag

SEQ ID NO: 26418 - DNA, 57 bp, Piromyces finnis
  PROKAR_LIPOPROTEIN
gaactttataaataaatctattttgttaacttttattacttttattgttggatgtct

SEQ ID NO: 26419 - DNA, 63 bp, Piromyces finnis
  PROKAR_LIPOPROTEIN
gaaatttagtactgttttagcttcttctattttagctgcaggagctttagcctcctcttgtca

SEQ ID NO: 26420 - DNA, 69 bp, Piromyces finnis
  PROKAR_LIPOPROTEIN
gaaaagcatttttgtattatcaactttaactgttttattaaaccattcagttttatcacaaagttgttc

SEQ ID NO: 26421 - DNA, 60 bp, Piromyces finnis
  PROKAR_LIPOPROTEIN
gaaattctctgctttaattggtactttattcgcaactggagctttagcctctagctgtca

SEQ ID NO: 26422 - DNA, 60 bp, Piromyces finnis; identical to SEQ ID NO: 26421
  PROKAR_LIPOPROTEIN

SEQ ID NO: 26423 - DNA, 60 bp, Piromyces finnis; identical to SEQ ID NO: 26421
  PROKAR_LIPOPROTEIN

SEQ ID NO: 26424 - DNA, 1662 bp, Neocallimastix californiae
  PROPROTEIN CONVERTASE SUBTILISIN/KEXIN
tgaacttattttagatcatatagatacctatcagaaggatgatgctatcacggaggaggttcaaagtttaatgcgaaagcgtagtgaaatgtcttatgaagatatttctaataatgaagctttttccaaaattttaactgaagcttttagtgttttagatgttaccgtcatctatgcctatctctcggaagaattatataatatcataaaggatttaccagatgtcgtatcctgtaatgaagatgtcgtcattcctttccccaatgatactataatttcaataaatgataccaatacttttgaaattaaatcagacaaaaaatttgagaaaagagcctcctattatgatctttacgacattaaaagggatacaaattggagtgatgttactgtctttgaaaatacttatcatcatttatcgcttatttctcaatctaaatatgatagaaatttagttggaaaatatgatcgaaacttttattatccaatctctgctggtagaggagtggatatttatattttagatagtggtatatatggtgaccatattgattttgataccggtcatcgtacggtgtcctgtgatgcgatgtttggtaaaactcgtgtcatcaatcaacctggctcttctaattataaaaattgttatctagaaaacgaacttaaattccatggttctatggtagcttcggtagctgcgggaaaatattttggtgtagcgaagaatgctaatattcatatgatagttcatgatcgtaccgctttaaatattctttatgcctatgattatgttaaaaaatatgccaaaaatcctcataaaacggtcattaatctttcctttggtaattatattcgtatacctgaagaagaaaaaatgattaattctttagctgaaatgggatttatagtgattgctgccgccggtaatgattatacgaatgcttgtaccaataatcctcgacaagtaaaacaagagggtcaaacagttaccgtcaccagtaaaatgtatcctgcagcgtatagtaacgtcatcgctgttggggccaccaataatgatattcaatcattagatgtgaccaacgttagtaatctttataatgttgcctctttcagtaactatggaaattgtcttgatatttttggtcctggttatgtctatggagcctatcctggatatgattatagaaataacaactctatacaagcttacgctggcggtacctcattttcttgtccaatagtggctggtgtggccgcttctataatttcagaacatcctgaaattgaatttaacgttactattttaagacagtggctattggataatgcagttcggaatattattggtaattcaagtcaatttgatagtccagatattttcttaaataatggtaagaaaacggtttattctgctaatggtcaatataatggttgtggtattctttctggtaaaagaacttgtcccggtgataattgctgttcagcttcaaccggttattgtggccgtaatttttgtgacattgattgtcaaagtgaatttggttactgtaacaacaaaaataacaatagttatgatgataatcaaaagaattgctggtcttctaatttgggctattcatgttgtccttcaggtactcctgtttactttacagatgaaaatgg

SEQ ID NO: 26425 - DNA, 1233 bp, Neocallimastix californiae
  PROPROTEIN CONVERTASE SUBTILISIN/KEXIN
tggacaatatgattcaaactattactatccttcttctgcaggtaaaggagtggatatatatattttagatagtggaatcgatgttcatcatgctgattttgaattggatactggtaatactggtaacggttatcgtaccgtgtcttgtgatgctatgtttggtgataaagaaattattaatcaacctggttcctcaagctacaaaaattgcttcttagaagagaaaataaaataccatgggagcatggtagcttcaatcgctgctggtaaaattcatggggtcgctaaaaatgctaatattcatatggtggtgcataaccgacagagtaccggtattctgttggcctataattttgttaaaaacaatcttaaagatcctcataagacggttattaacctatcatttggcagttataaaaaaattccagaagaggtatcattaattaattcgttaattgaaatgggatgtatcgtggttgcagctgggggtaatgataacatcagcagttgtaccacggaacctagatatgttgtttcggatgacgataataaggtaaaaaccctaatacaggaaaagatttatcctgcttctctggaaaatgtcattggcgttggatcaatacgtaacaaaattaaagaaacggatgtttcaagtgttcagaacttgtatagccttgctgattttagtaattatggggattgccttgatctatttgctcctggttatgcctatgccgcctatccaccacccaataataacgataaaagttcttctgatttggaaggctacggcgggggttcctctttttctgcaccccttgtcgcaggggtggcagcctctataatttcagaacatccagaaatgacatttaatcattccctaatgaaaaaaatgcttctggaaatttctgtggagggtattctcgatcaatctggaatccatgatagtcccaataatttcttaaatatcggtaagaaaactgtttattcggcaaataatcagtataaaggttgtggaatcttttccggtaaaagatcttgttctaataatgaatgttgttcttcctctactggttattgtggtcgtaacgatgactactgtggctctgactgtcaaagtgaatttggctattgtacctccagtaacagcaataataacagcaacggtagcaacaacaatggcaatactaccaacaacaatgataacaaaagtaataacgataatagtaatgg

SEQ ID NO: 26426 - DNA, 1371 bp, Anaeromyces robustus
  PROPROTEIN CONVERTASE SUBTILISIN/KEXIN
tagagttgacagtaatgatattaatatttataagcgttcattcaattcaactgattcagatgtagaatatatacctgttgaattaaatatacttcatcatatatcaccaattttaaattattatactattttagtttatctttctgacgaacttgttgatcaagttcaagctttaccaaatgttataagttgtgaaaaatcatttaaaattcaagaccaagtatataaagaagaggaagaaattttaattaataataataataataataataataatgttaataataataaagaaaaaagagatgattttgattttgaaaaatatcaagaagaagaaaatatggattatggaatatattatgatattgacaaaataaaagaagaaactaaatggtcaggcgttgaagttcaatataatgctaataaacatagtgaaaatgatgattctcatttatctttattatctcaaggtagattttataaagaagtcacaggaagatatgataataattattattatccttcttctgcaggaaaaggtattgatatatttttaatagataaaggactttatttagataatgatgattttgatagatatgaaggaacagaggatgaacgtacattaacgtgtgatgctttagttgtttatggtgtagctcatccttatgaaggtgaagataaaaagaaatgtaaatttgctgaagatagttatccaggtcatggtaatatggtttcttccttagcaggaggaaaattatacggtgcagcaaaaaaggcaaatttacatatgattgtttcttattatgaattatatgaaactattgtagcattagattatatcaaacaaaatggtaaaccttatcaatccattattagtttttctcgaggagcttataaaaaatatagtcaatttttacaagataaattagatgaattaaatgatgcaggatttattactgttgttgctgctggtaatgaaacggaagatatatgtcatgaaaaaaataaatatttttattctatagcaggctataaaaatgtaattattgtaggttcaacagaatcaacttacaataatgatattgaaaatggttataaaattgcttcttactcaaattatggggaatgtattgatatttttgctccaggtcaagccagatatgcaaattatcaattaaatagaaaagcacaaggtacttcagtatctacagcgattacagcaggagttatagctactattatgtccgaacatcctgacattaaatttaatgtagatactatgaaagaaaaattatttgaattatcattaaaaaatattattagtggattaaataatgttacaccaaatagatttttaaataatggtaa

SEQ ID NO: 26427 - DNA, 1054 bp, Neocallimastix californiae; identical to SEQ ID NO: 14516
  PROSTAGLANDIN REDUCTASE 1

SEQ ID NO: 26428 - DNA, 1051 bp, Anaeromyces robustus; identical to SEQ ID NO: 14522
  PROSTAGLANDIN REDUCTASE 1

SEQ ID NO: 26429 - DNA, 1056 bp, Piromyces finnis; identical to SEQ ID NO: 14523
  PROSTAGLANDIN REDUCTASE 1

SEQ ID NO: 26430 - DNA, 2751 bp, Anaeromyces robustus; identical to SEQ ID NO: 26320
  PROTEIN C41A3.1

SEQ ID NO: 26431 - DNA, 6577 bp, Anaeromyces robustus; identical to SEQ ID NO: 26321
  PROTEIN C41A3.1

SEQ ID NO: 26432 - DNA, 712 bp, Piromyces finnis; identical to SEQ ID NO: 26333
  PROTEIN C41A3.1

SEQ ID NO: 26433 - DNA, 882 bp, Neocallimastix californiae
  PS-DH
taccggtaagaatgaacttgttgtcacagctccattaactccacaatacgtgaaatatttatgtaagaatcatgtcgtcagtggtaatggttgtgttccagctgcagcctacaccgaattcatctttgccgctgtgaaggccatgaataataataccgatgacgttatcgaaatcgctgatgaactcttagttcgtggtccattaaccattaaggaagattccgaggtggactttatcttaaagaaaaagggtgatcgtctttctctctacactaaattagatggtggtatagaaaatcatatgttaaacgcttccgctaatctcttaagagatggtgaaaacgtcaatattcgtgataccttaccaacgccagcccaagctaaggctttaattaataaaatcttaaccaaggataacattcattcctccaagctcatctatgacagtatcagtaaaaatattagctacaatggtggattcccatccgtgaaacactttggtcttggaaatgatgatgatggtcagtacgttcttgtctctcgtattgattcgaaggataagacccttaacaatattcgttcaggtcttaatcaggtttatctcttcgatgcctcgctccactccaatgccggtagaagtagtattgaggaggagaagaagggagaaggtcgtgaggaagaaaatgaacctttccttccttcctcttttgaaaatattatcaagttcaaagcaactccagatgaatgctttgttgttcatagatatattggtaacaccgatccaaactctgaattcactaccttctctgtttacgatttagatggtaatatttgtgaatatgttggtgccttccaaactcgtaaagttaaaattgaaacgaa

SEQ ID NO: 26434 - DNA, 807 bp, Neocallimastix californiae
  PS-DH
tcatgttattaatggaaagggattcagtccagcgacttcatttattgactttgtcttctacggtttaaagtttgcttatccaaatgaccaatttaagattaatgaatatttcattaccaatggtccattaagtcttagttatgaccatgatgttgtttacattatggtaaagaaaggtgaagaaattactatttactctcaaacttatggtggacaacaagaaatgagaggttctgttatagtttccgttgctaattctattgatagtgaaaaagccacagatgaactcggctttgatgttaagaaggattacgttgaaaagtacttaagtggtccaggagctaaggatagttcaaattacggtgaaggtaaggaattatacgaagaaatggataagagtcttgtttacggtagcttcttcagatctgttcaatccttctattcaggtaaggaacaagatggaacagaattccttatcagtcatattaagcacaacgttaagcaagttgaagaatcacttgttaattctggtgcttctcaagttggtattttagatgctgctattcattgtatgagtggtgatggtattgttgctaagaagaatggtgttgaaggatctaaggatagtttccttcctacttcatttgaaggtattattaagtacaaggaaattccaaatgaagtttatgttcttcatcgtgttaagagtgttaatgaaacttcgaagtttactcaatactgggtctttgatgttgatggaaaacttgtcttctctactgataacttccaagttaagaagtttgatat

SEQ ID NO: 26435 - DNA, 780 bp, Neocallimastix californiae
  PS-DH
tgaaaatcatagatatcttcaagatcatgtcgtcaataaaaaaattgttcttccagctgctggctccgttagtcgtgctttcagtggtttcgctactgctcatccattaaaggttgctcaaagagccatcatttctcttgaggatttgaagtttgatcgtatgggtatctttgataaaactattgattttaatactgccactggtccaatgccaattacttatgaagaggaaagaagtaaccaaacctataaaattatctttaatgaggatgttgaagtttcttcaggtaaatttaataacaatgatgaaactgaaaccttaaagaatattccagctgtagattacttcattaatcaatgttcatcgatcgctggtggtcaaggtgttactccagctatgttttataatcgtactcaagaaattggtttagattatggagaggaattccgtttatataaggccattcgttcaggaaagaatgttgcttatggtaaattaactgtaagtaaagaacatcaaaagatggtttgtcaccctgccgttttggataattgtattcaaatcgtttttgcctctggtgttgctgctggtgattgtcaagctcttccagtaggtatgaagaaggttgttttaagtcaaggtggtcatttcccagaaggtactcttattgttgctactgaattagttaaacaagatattaaggaatgcgtctccaatgtttatatctatgatgaaaataaaaatatctttggttatgttgaaggtttgacaatgtcttt

SEQ ID NO: 26436 - DNA, 801 bp, Neocallimastix californiae
  PS-DH
aaatcataagtatttagttgatcacattgttggaaaggatgttgtatttcctgctgcaggcagtattagccgtgccatgtatggtttcaagcaaagtagaggcgaatacaatttcgataaagatagaaatattgtttttgaaaatcttgagttcttgcatttggcagttttcgaaaaatcagttcaagaacaattaaataagaaaggtccaattccaatttctcttgtggaagaaggcgatggtaaatacactattgttcaaaagaatggtaatcctgtaagtaagggtcaattctatgaagctcaattgactcaaagtaaggaagaaaattctaacttactaagtgatgtaccaacatttaatgaatttattaatagatgttctactaaggttggtggtaatggtgttacctctgaacaattatatcatagaacagatgaattaggccttaagtatggtccaaacttccgacttgttcaaaattgtagagctggtgataatgttggttatgctcgtattaaggtagatgaagaaaagtctaaacttatttgtcatccagcagttcttgatgcctgtttccattccatcattggtactggtattgctaatggggatcgtcaacctttaccaaataaaattagaagatttgttatgggtcgtggtggttacttcccacaaggtaccattatttgtgctgctgatattataaagcaagacttgaagaatgttattgtgaatatttacatttatgatgaagataagaagccaattgctaagattgaagaaatggatatgactat

SEQ ID NO: 26437 - DNA, 771 bp, Neocallimastix californiae
  PS-DH
tcaatatttagtggatcataaggttaataatcaaattgttttcccagccgctggtagtgttagtcgtgccctctatggttatgaaagaagtcgtggtattatcgaatccgaatctatagttaccttaaatgatttagaatttgtaggacttaccgtatttcagaagaccgtcgaaagtcaattgaggagtaagggacttattcctatgaaattgtatgaagatgaggatcatcaatttattttgaaacagaatgatggttccgtgattagtaagggtaccttcccacctcttcattctcctaaggaatccgaagtattaagcaacttcccagaattttcagaagtaatcaagagttgttccacggtgaagggaggtgaaggtattcgtaaggaacaaatctatcaacgagccaataccattgagcttcaatatggacctcaattccaattgattcaacatggacgttctggtaaaaagtattcctatgccaagattgctgttcgtgaagatcatgcccaaatgatttgtcatcctgccgttctcgataactgtttccactccatcatatgtttaggccttggttgtggtaatcgtcaagtgcttccttacaagattaagcgtttagaaatgaagaatggaggtcgtttcaaggaaggtatccttacctgtgtcagtcaattgatatatcaagatttaagtcgggtgatggttaatctctttatctatgatgatgctggagaaccgttcatgaagattgatcatatggaatt

SEQ ID NO: 26438 - DNA, 864 bp, Neocallimastix californiae
  PS-DH
taagaatgaactcgtcgtcactgctccactgacgccacaatacgtcaagtacttatggagtaaccatattgtcatgggagttggttgtgttccagctgctgcctacacggaattcatcattgctgccaccagagctatgaataacggttcagaggaaccaattgaagttgtcgatgaattattaactcgtggtccattaaatattaaggaagattcggaagttgatttcatcttaaagaagcggggtgaacgtcttgctctctacactaaggttgatggtggtatggaaaaccatatgttaaatgctcaggctaacctcttaagtgatagtgaaaatccaaacattcgtgaaaccttaccaaccccagaaaaaactaaggctttaattaagaaggttttaacggaagataacgttcatccaggtaaattcatttatgataatattaaaaggagtagtctttacaaaggtgggttcccatccgtcaagaactttggtatcggttatgatgatgacggtacctttgttcttatctctcatcttgattccgttgatcgatccattaacaatactcgttctggtcttaaccaagtttatcttttcgatgctacccttcactgtagcgccggtaaggattgtcttagaacgcaagataaaccggaagaaaatgaaccgttccttccttcctccttcgaaaacttggtgaagttcaaacaaactccagatgaatgctatgtcgtccatagatatttgaaggaaaacgctgaaaccgatccaaactctgaattcacctctttcaccgttttcgatatagatggtaatgtttgtgaacattgtagtgccttccaaactcgtagagttaagtt

SEQ ID NO: 26439 - DNA, 765 bp, Neocallimastix californiae
  PS-DH
taacgcctatttagtagaccataaggtcaataaccaaattgttttcccagcggcaggcagtattagtcgtgccttatatggttttagtagaagtagaggccaaatggagaagaaatctatggtttctttaactgatttagaatttattggtcttaccgttttccaaaaagatgaggaaagtcaattgaatagtaagggtccaattcctatgaagctttatgaaagtagggaacatcaattcgctttgaaacatcaagatggttcaatgattagtaaaggtgtttttcctgacagtagtcccaaggaacttcttgatttcccagaattatcggaaataatcaagagttgctccaccgtaaaaggtggggaaggtattcgaaaggatcttatatatcaacgtgccaatgccatcgaacttcaatatggtcctgaatttcaactaattcaacatggtcgttctggaagaagttattcctatgtcaagattgaggtcagagaggaccactgtcaaatgatttgtcatcctgccgtacttgataactgtttccattcagtgatatgtttaggtctcggttgtggtaatcgtcaagtacttccctttaagataaagcaattcgatatgatgaatggaggttatttcaagactggtactatcacttgtgtaagtcaattaatctatcaggatttaagtcgtgctattatcaatttttttgtttatgatagtgatgatcaacccttcatgaagattgatcatatggaattttt

SEQ ID NO: 26440 - DNA, 879 bp, Anaeromyces robustus
  PS-DH
taataatgataatgaagttattgtttctgctccattaactccacaatatgttaaatatttaagtaaaaaccatgttattattggtcatggttgtgttccagctgctgcttatactgaatttatctttactgctatgaaagcacttaacaataatcgtgatgatcttattgaaattactgatgaaatgtttgttcgtaatccattagatattgaggaagattctgaagttgatttcattatgaaaaagagaggtgatcgttttgctatctatgcaaaattagatggtggtgttgaaaatcatatgttgaatggaagtgcttgtcttttaaaggatggtgataatgctaatcttcttgaaacattaccatccaaggaagaaatgaaatcctttattaataaatatcttaatgaagaaactatgtattctagtcaaattatttatgatagtatttttgaacatagtttctatggtggtggtttcccatctgttaaaggttttaatgttgctaaggatgaaaagggaggattccttatttcacgtcttgattcaaaggataaaactcttaataatattcgttcaggtctttcacaagtttatctttttgattcttctattcattctaatgctggtagaatgtgtcttgaaaaattacaaaagaaagaagaagacactggaccaaatgtaccattccttccatctacatttgaaaatattataaaaataaaaccaactccagatgaatgctatgttattcatagatttattgaaggaactgaagctaatagtaatttcacttccttctctgtttatgatttagatggtaatattgtagaatatattggttcctatcaaactcgtagagttaatatggaaaactt

SEQ ID NO: 26441 - DNA, 798 bp, Anaeromyces robustus
  PS-DH
aaatcataaatatttagttgatcatattgttggaaaggatgttgttttcccagctgctggtagtgtaagtcgtgccatgtatggatttaaacaaagtagaggtgaacataattttgatagtgaaaagataattgttttagaagatcttgaattccttcatttagccgttttccaaaaatccgttcaagatcaattaaatatgaaaggtccaattccactttctcttatagaagaaggtgagggtaaatatactcttattcaaaaagatggtactccagttagtaaaggtcatttctatgaaccacaacttactcaaactcgtgaagaaaatgctaatttattaaatgatgtaccaccatttgaagaatttgttaatagatgttctacaaaggttggtggtaatggtgttactgcctctcaattatatcatagaacggatgaattaggtcttaaatatggtccaaacttccaacttgttcaaaatggtagagcaggtgataatgttggatatgctcgtattaaggtagatgaagataaatccaaacttatttgtcatccagctgtacttgatgcttgtttccattctattattggtattggtattgctaatggtgaccgtcaaccattaccaaataaaattaaaagacttattattggtcgtggtggttatttcccacaaggtactattatttgtgctgctgatgtgataaagcatgacttaaagaatgttgttgttaatatttacatttatgatgaagaaaagaaaccaattgcaaagattgaagaaatggatatgat

SEQ ID NO: 26442 - DNA, 861 bp, Piromyces finnis
  PS-DH
caacgaaagcgaacttattgtcgctgctccattaacaccacaatacgttgaatacttattcaagaaccatgttatcacaggttatggttgtattccagctgctgcctacactgaattcatttacactgctatgaaggctatcaataactatgaagatgatattattgaaatctgtgatgaaatgttaattcgtagtccattaaatattaaggctgattctaatgttgatttccttatgaagaagaagggtgatcgtattgccgtttatgctaaagttgacggtggtattgaaaatcatatgttaaatgcttctgcacttctcttaaaggaaggtgaaaatgctgatctttttgacactcttccaaagccagatgaagttaaggccttaattgaaaagattatgactaaagaaaacactcattcatctgatattctttacgatagtattcgtgaaagtagtctttacggtggtggtttcccatctgttaaggaatttgctgttggtactaatgacgaaggttctactgttttagtttcaagacttgactctaaggatagaactattaataacatcaactctggactttctcaagtctacctctttgatgctgctcttcatagtgatgctggtaaggatacccttgtagctattaaaaaagaaaatatgggtgatccattccttccatcttcatttgaaaatcttatcaagtacaaaccaattccagatgactgttacgttattcacaagcacatggaaggaactgaaccaaatgcagctttcacatccttttctgtttacgatttagatggtaatatttgtcaatattgcggtgctttccaaactcgtagagttaagatgaa

SEQ ID NO: 26443 - DNA, 798 bp, Piromyces finnis
  PS-DH
aaatcataaatatttagtagaccatgttgttggaaaggatgttgtcttcccagctgctggtagtgttagtcgtgcaatgtatggtttcaaacaaagtagaggtgaatataactttgataacactcgtaacattgtctttgaaaatcttgaattcttaaacttggctgtcttccaaaagtctgctcaagaacaattaaataaaaagggaccaattccactttctcttgttgaagaaggtgaaggaaagttcagtattgttcaaaagaatggtattccagtaagtaagggtcaattctatgagccacaacttactcaaagtaaggaagaaaacgctaacttattagatgatgttccaccatttgaagaatttgttaacagatgttctaccaaggttggtggtaatggggttactgctgctcaattatacaaaagaactgatgctttaggtcttatgtacggtccaaacttccaacttgttcaaaatggaagagccggtgataatgttggttatgctcgtattgaggtcgatgaagaaaagtctaaattaatttgccatccagctgttcttgatgcatgcttccattctattattggaacaggtattgctaatggtgaccgtcaaccattaccaaacaagattaaaaaattcattatgggtcgcggtggttatttcccacaaggtacaattatttgtgctgctgatattattaaacacgatttaaagaatgttgttgtcaatatatacatttatgatgaagaaaagaaaccaattgccaagatagaagaaatggacatgat

SEQ ID NO: 26444 - DNA, 882 bp, Piromyces finnis
  PS-DH
ttctgaatcaaacattattattactgttccattaagtactcaatacattcgtttcttaagaagaaagcatcaaatttcttcaactggtttcagtccagctacttcctatattgattttgtattctatgctttaaaatacgcttatccaaacgaacaatttaagattgatgaatacttcattactaacggtccattaaagcttactgatgatcaagaagttgtttatattatgattaagaagggtgaagaagtcactatttattcacaaagtcgtggtagtccacaagaagttagaggatctgtcatgatatctgtagttaataatcttgataatgaagaagctacttccaagcttgattttgatattaaaaaggattatgtcgaaaagtatttaactgttgaaaatgctaataaatcaccaaactatggtgaaggtaaagaattatatcaagaattagataagagtattgtttatggaagcttctttagatcagttaaatctttctactctggtaaagatgaaaatggtcatgatttccttgttagtcatattatgcataatgtttcagataaagatgaatctcttgttaattctggtgcatcccaagtcggtatattagatgcttgtattcattgtatgggtggtgatggtattattagcaacagaaataatactaacaatgaaaagtctaaagatactttcctcccaacttcatttgaaggaattattaaatataaggatattccaaatgaagtatatgttcttcatcgtgtaaagaatgttaacgaaacctcaaagtttactgaatactttgttttcaatactgaaggaaagcttgttttctctactgataatttccaagtcaagaaattcgatactac

SEQ ID NO: 26445 - DNA, 882 bp, Piromyces finnis; identical to SEQ ID NO: 26444
  PS-DH

SEQ ID NO: 26446 - DNA, 549 bp, Piromyces finnis
  PS-DH
aaataatcaatatttagtagatcataaggtgaataaccaaatcgttttcccagcagcaggtagtgtaagtcgtgcaatgtatggtttcttgaatagtagaaattctcaaaaaatacaagaaagtaagggtcatgtcgctttaactcaattagaatttacaagtttatctgtattccaaaaacgtgctgaagatcaattaaatagtaagggccctattccaatgaaactttatgaagataagaatcatcaatttactttaaaacatcaagatggttcaattattagtaagggtaattttgttgaaattgcaaaggaatttactgatttccctaatctttcggatgttgtcaagagctgcaccactgtcatgggtggtaaaggaattcataaagatcttatttatcaacgtgcagcagctattcaactccaatatggaccagaattccaattaattcaatctggccgttctggaagaaactattcctatgtaaaaataagggttactgaagaacattcaaagatgatatgtcatccagctgtcttagataa

SEQ ID NO: 26447 - DNA, 777 bp, Piromyces finnis
  PS-DH
tgaaaatcatcgttaccttcaagaccatgttgttaacaaaaagattgttcttccagcttgtggctctgttagtcgtgcctttagtggttatgccaatgctcatccattaatgatggctcaaaaggctatcatttctcttgaagatttgaaattcgatcgtatgggtatctttgataaggctattgactttaacactgttactggtccaatgccactcacctttaaggaagaaggcagtaccaatacttataaggttatatttaatgaagatactgaagtttcttccggtaagtttaacgatgcagatgaaactgaagccttaaagcaaattccatctgctgattactttatcaaacaatgttcttctgtcagtggtggacaaggcgttactccagacatgttctacaaccgtactcatgaaattggtttagactatggtaaggaattccgtttatataaggctatacgttctggtaagaatgttgcttatggtaaacttgctgttagtaaggaacaccaaaagatggtttgtcatccagctgtcttagataactgtattcagattgtttttgcttctggtgttgcctctggtgattgtcaagcccttccagttggtatgaagaaggttgttttaagtcaaggtggtcatttcccagaaggaactcttattgttgccactgaattagttaaacaagatattaaggaatgtgtctctaatgtttacatttatgatgaaaacaagaatatatttggttttgttgaaggtttaactatgtc

SEQ ID NO: 26448 - DNA, 78 bp, Neocallimastix californiae
  PT
acaaccaactgaagaaccaactgaacaaccaaccgaacaaccaaccgaagaaccaaccgaagaaccaattaaagaatc

SEQ ID NO: 26449 - DNA, 66 bp, Neocallimastix californiae
  PT
accaactgaagaaccaactgaagaaccaactgaagaaccaactgaagaaccaaccgaacaaccagt

SEQ ID NO: 26450 - DNA, 1092 bp, Neocallimastix californiae; identical to SEQ ID NO: 14267
  PURPLE ACID PHOSPHATASE 23

SEQ ID NO: 26451 - DNA, 912 bp, Neocallimastix californiae; identical to SEQ ID NO: 14269
  PURPLE ACID PHOSPHATASE 23

SEQ ID NO: 26452 - DNA, 948 bp, Neocallimastix californiae; identical to SEQ ID NO: 14270
  PURPLE ACID PHOSPHATASE 23

SEQ ID NO: 26453 - DNA, 963 bp, Neocallimastix californiae; identical to SEQ ID NO: 14271
  PURPLE ACID PHOSPHATASE 23

SEQ ID NO: 26454 - DNA, 1038 bp, Neocallimastix californiae; identical to SEQ ID NO: 14272
  PURPLE ACID PHOSPHATASE 23

SEQ ID NO: 26455 - DNA, 990 bp, Anaeromyces robustus; identical to SEQ ID NO: 14274
  PURPLE ACID PHOSPHATASE 23

SEQ ID NO: 26456 - DNA, 1035 bp, Piromyces finnis; identical to SEQ ID NO: 14278
  PURPLE ACID PHOSPHATASE 23

SEQ ID NO: 26457 - DNA, 918 bp, Piromyces finnis; identical to SEQ ID NO: 14279
  PURPLE ACID PHOSPHATASE 23

SEQ ID NO: 26458 - DNA, 1029 bp, Piromyces finnis; identical to SEQ ID NO: 14280
  PURPLE ACID PHOSPHATASE 23

SEQ ID NO: 26459 - DNA, 1029 bp, Piromyces finnis; identical to SEQ ID NO: 14280
  PURPLE ACID PHOSPHATASE 23

SEQ ID NO: 26460 - DNA, 243 bp, Neocallimastix californiae
  Purple acid phosphatase, N-terminal domain
atcaaaacttaattttggttggtattctaaatctaaggaatatccattaatccgttttggtgtttctaaagatttaactgaagaaaatgaagtaacaggtactagttatcaatgtaaaaatattgatgatgtacaatactattgtaatcaagttactgttactggattggaaagtttatcaacttattattatcaaagaaatttaaatggaaagtgggaagatgtaattgaatttaaaactaa

SEQ ID NO: 26461 - DNA, 222 bp, Neocallimastix californiae
  Purple acid phosphatase, N-terminal domain
ggaatctgtaactgataataaaccatatattcgtatttcaaagaattctgatatgacagattataaagaattttctggtgataatgacttttatagaaaactaggaggttctacctattacgttaacaaggttactgttgaaggtttagaacacaataccgaatattattatcaaagaaaattaaatgaagattgggaggaagcagctaaatttactactag

SEQ ID NO: 26462 - DNA, 240 bp, Neocallimastix californiae
  Purple acid phosphatase, N-terminal domain
caaacttaattttggttggtattcaatttcaaatgaataccctcttattcgtttcggaagtacttctgatttaactgaaaaagatgaagtaagaggtatcaattttaaatgtaaaaatattaatgatacccaatattattgtaatcatattactgttactggattaaaaagtaataccatctattattatcaaagaaatttgaatggaaattgggaagaaacaattgaatttgaaactag

SEQ ID NO: 26463 - DNA, 243 bp, Neocallimastix californiae
  Purple acid phosphatase, N-terminal domain
atctcaacttaattttggttggtattcaactactacagaatatcctctcattcgttttggtactactaaggaattaactgaagaagatgaagttaaaggtgataattatgaatgtaaagcaattaatggtgtccaatattattgtaatcaagtttcagttactggtttaaaaccaaattctatttattattacaaaagaaatttagatggaacttgggaagagacaattgaatttaaaactaa

SEQ ID NO: 26464 - DNA, 150 bp, Neocallimastix californiae
  Purple acid phosphatase, N-terminal domain
taatggaaagaacgaatattacagagagttagatagaaaaaaatattatgccaatcaagttactgttactggtttaaaaccaaattcagtttattactatcaaagaaaattagatgatgaatgggaagatgtagttgaatttaacactta

SEQ ID NO: 26465 - DNA, 144 bp, Neocallimastix californiae
  Purple acid phosphatase, N-terminal domain
agaaaatgaattctatagaaaaaaagatgatgttaattattattcgaataaagttacagtttcaggtttagaacctaattctgtttactattaccaaagaaaattaaataataaatgggaagacccagtaaaatttaacacctt

SEQ ID NO: 26466 - DNA, 243 bp, Neocallimastix californiae
  Purple acid phosphatase, N-terminal domain
atctcaattaaattttggttggtattcaacttccagcgattattctcttattcgttttggtacatccaagaaattatcagaaaaagatgaattcgtcggtagtagttatgtatgtaagaatataaaaaatgttcagtattattgtaatcaagttactgttaccggattggaacgtaattcgatttattactaccaaagaaacttaaatggtaaatgggaagatccaattgaatttaaaactca

SEQ ID NO: 26467 - DNA, 243 bp, Neocallimastix californiae
  Purple acid phosphatase, N-terminal domain
atctcaacttaattttggttggtattctactactacggattattctctcattcgttttggtactacaaaatatttaaccaaagaaaatgaagttagaggtacaaattataaatgcaaagcaattaatggtacccaatattattgtaatcaagttactgttatcggtttagaaccaaattctacttattattatcaaagaaatttaaatggaaattgggaagagtcaattgaatttaaaactca

SEQ ID NO: 26468 - DNA, 279 bp, Neocallimastix californiae
  Purple acid phosphatase, N-terminal domain
atcagttttttctggtgataatgaatccatgcttaattttgggtggtattctactgaagatactaaaccagttattcgttttggcactcaagaagatatgtcggatgctaaagaattcactggtaatgttgaatattataaaaacttattaattggctcacgaaagtattctatatactcaaatcaagttacagtaagtggtttagaacgtaataatacttattattaccaaagatatatagatggaaaatgggaaaaatcagttaaatttgttactcg

SEQ ID NO: 26469 - DNA, 150 bp, Neocallimastix californiae
  Purple acid phosphatase, N-terminal domain
tacaggtaaaactgaatattacagagaattctatggaatgaattattattctaaccaagttaccgttaccaatttaaagccaaattcaatttattactatcaaagacaattaaatggtaaatgggaagatcctgttcaatttaatacgta

SEQ ID NO: 26470 - DNA, 240 bp, Neocallimastix californiae
  Purple acid phosphatase, N-terminal domain
acaacttaattttggttgggaatcattaactaatattgaacctgttattcgtatctcttcagataaaaatatgaaaatttataaagattttattggtaaaaatgaatattacagagaattagatggtaataaatattattctaatcaagttactactactggtttaaaaccaaattcagtttattactatcaaagaaaattagatggtaaatgggaagatgttgttgaatttaacactta

SEQ ID NO: 26471 - DNA, 246 bp, Neocallimastix californiae
  Purple acid phosphatase, N-terminal domain
tgaatctaaacttaattttggatggtattcttcaacaaagtcaagtccaattattcgtttttatactaataaagataaatcggaatataaggattttactggttcagtggaatattataaaaaaataaatggtaaaaaatattattctaataaggttactgtgactggattgaaacgtaataaaacttattattatagaagaagtttaaacggagaatgggaaagttccgttaaatttaaaaccta

SEQ ID NO: 26472 - DNA, 135 bp, Anaeromyces robustus
  Purple acid phosphatase, N-terminal domain
tagaagtaaatatatcagaaaacaaggttatatgattaatagagtaactgtttctggtttagaacgtaataaaacttattattatcaagtatatatggatggagaatgggaaaaacctgttgaatttaaaactta

SEQ ID NO: 26473 - DNA, 225 bp, Anaeromyces robustus
  Purple acid phosphatase, N-terminal domain
ttggtattcaacaagtggaactgaacctgccattcgtctcagtagtaataaagacatgtctgattatactgattttattggcacagttgtttattataaaatccaaactagagtaaaatattattctaataaggttacagttactggcttggaacgtaattcaatttattattatcaaagaaaattaaatggtaaatgggaagatccagttcaatttaatacata

SEQ ID NO: 26474 - DNA, 225 bp, Anaeromyces robustus
  Purple acid phosphatase, N-terminal domain
atggtattcaagaactgatgattcaccaattattcgttttggtcctaaaaaagatatgaataaaaacaaagaattcgtgggtactgttaacttttttagaaatatcaaaggaataccttattataccaatagagtaacagttactgatttaaaaccaagatcaacttattattatcaaagaaagttaaatggtgaatgggaagatataattgaatttaaaactgg

SEQ ID NO: 26475 - DNA, 255 bp, Anaeromyces robustus
  Purple acid phosphatase, N-terminal domain
tcctggtgaagatgaatccaaacttaattttgcttggtattcaagatctgaagaaaatccagttatgcgtttaagtgaaaatgaagatatgtctgattatacagaatttactggtactaataattatattagaaaatatcttggtgataaatattattccaataaaatttcaattgaaggtttaaaacctaaatcaacttattattatcaaagattattaaatgatgaatgggaagccccaattaaatatactac

SEQ ID NO: 26476 - DNA, 228 bp, Anaeromyces robustus
  Purple acid phosphatase, N-terminal domain
tggttggtattcaacaactgaaactgaaccagttattcgttttggttctaatgaagatatgtcaaatgctaaagaatttattggtacaagagaatttgcaaaagctttggatggaaaaaattattattcaaataaagttgtagtaacaggtttagaacgtaattctatttattattatcaaagaaaattaaataatgaatgggatagacctgttcaatttaggactca

SEQ ID NO: 26477 - DNA, 225 bp, Anaeromyces robustus
  Purple acid phosphatase, N-terminal domain
ttggtattcaaccactaataaaactccggttattcgtttaagttcaaataaagatatgtcaaattataaagattttacaggtagtaatgaattatacaaaactttatcaggtattaattattattctaataaggttacagttactggtttagaccgtaattcagtctattattatcaaagacaattaaatggtatatgggaagatccaattttatttaaaactta

SEQ ID NO: 26478 - DNA, 237 bp, Anaeromyces robustus
  Purple acid phosphatase, N-terminal domain
tatggttaattttggttggtattctactacagaatcaaatccaataatacgatttagtagtaatcaagatatgtctaatgctaaaaattttattggaactattgaaaaatatatggtattaaataataaaacttattattcaaataaagttacagttactggattagaacctcattccacttattattatcaaagaaatttaaatggtaaatgggatgaacccatttcattttttaa

SEQ ID NO: 26479 - DNA, 150 bp, Anaeromyces robustus
  Purple acid phosphatase, N-terminal domain
tgttggtaaaatagaattttatagagaaataggtggacaatcctactattccaataaagtaactattagtggattagaacgttcatccacttattattatcaaagaagattaaataataaatgggaatctgccattaaatttaataccta

SEQ ID NO: 26480 - DNA, 255 bp, Anaeromyces robustus
  Purple acid phosphatase, N-terminal domain
tggtgaagatgaatcaaaacttaattttggttggtattcaacctccaattcaaaaccaaagattcgttttggtagtaaaaaagatttgtccgatgctaaagatttcactggtacaaattcttattataagacattaaatggtaaaaaatattattcgaataaagttaccgtaaccggtttaaaacgtaaatccacttattattatagaagaaatttaaatggaaaatgggaagaaacgattagattcaataccta

SEQ ID NO: 26481 - DNA, 246 bp, Piromyces finnis
  Purple acid phosphatase, N-terminal domain
tgaatcttctcttaattttggttggtattcaactaccgaaaccatcccatccatttgttggggtactactaaagatacaagcgattgtgaagaattcaaaggtacagttacctattttaaggatttaagcggaacatcttattattctaatgctgttactgttaaaaatataaaacgtaatacaacatattattataaaagaaagttaaatggtcaatgggaaaaaccaattcaatttaaaaccta

SEQ ID NO: 26482 - DNA, 261 bp, Piromyces finnis
  Purple acid phosphatase, N-terminal domain
tgttggcgataatgaaagtgaacttaatttcggatggttgtcccttacggataaagaaccagctattcttttcggtaaaatgaaagacctttctgatggtgaaatatttactggtagtaatacactttacagaaaaatttttgatgagagctattattctaataaagttacggtcactggattagaacgtgaatccgtttattattataaaagaaaattaaatggtcgttgggaagatgaaattattcaatttaaaactta

SEQ ID NO: 26483 - DNA, 285 bp, Piromyces finnis
  Purple acid phosphatase, N-terminal domain
tggagaagatgaaacaaaaattaattttggttggtattccactcaaaattctactccaaagatccgtataggtaaaaataaagatatgagtgatgctataacttatagaggtacaactgaaattcaaattgaaagaatagattatggtggttctttctattacaatgaagataatgtattattaaatggaaaacgttatttcactcatagagttactgttgaaaatattgaacgtaataccacttattattatcaaagatatatctatggtgaatgggaagatgc

SEQ ID NO: 26484 - DNA, 237 bp, Piromyces finnis
  Purple acid phosphatase, N-terminal domain
taactttggttggtattctaccactaaaaatgaagtaccaactatttgttggggaacagatgaaaatttaaatgattgtaaggaatttataggaacaagtgaaaagcattataaggtcagtggaatacagtactattccaataaagttagtgttactggcctagaacgtaattctgtttattactacaaaagaaaattaaatggtcaatgggaaaagccaattcaatttaaaaccta

SEQ ID NO: 26485 - DNA, 237 bp, Piromyces finnis; identical to SEQ ID NO: 26484
  Purple acid phosphatase, N-terminal domain

SEQ ID NO: 26486 - DNA, 210 bp, Piromyces finnis
  Purple acid phosphatase, N-terminal domain
aactaaacttaattttggatggtattccactactaaaacactaccttccataagatatagtgtcaataaagacatgagtgatgccgtgcaatatgacggttattttgaacaacattataaattaaatggaacacaatactattctaacaaagtaaccattgaagatttaaaaccaaacaccgtttattactatcaacgattattaaatgg

SEQ ID NO: 26487 - DNA, 210 bp, Piromyces finnis; identical to SEQ ID NO: 26486
  Purple acid phosphatase, N-terminal domain

SEQ ID NO: 26488 - DNA, 267 bp, Piromyces finnis
  Purple acid phosphatase, N-terminal domain
tgttggggaagatgaatctatgcttaatttcggttggtattctaccatggatgaaattccatccattcgttatggtacggcagaagaagatgaatctcaatacaaagaatttactggtacccttcttaaacatcgtaccatcaaagataccgtctactattctaataaagttaccattactggtttacaacgcaacaccatttattactatcaaagaaaattaaatggtatttgggaacctgctgttgaatttaaaacttatccttc

SEQ ID NO: 26489 - DNA, 267 bp, Piromyces finnis; identical to SEQ ID NO: 26488
  Purple acid phosphatase, N-terminal domain

SEQ ID NO: 26490 - DNA, 267 bp, Piromyces finnis; identical to SEQ ID NO: 26488
  Purple acid phosphatase, N-terminal domain

SEQ ID NO: 26491 - DNA, 267 bp, Piromyces finnis; identical to SEQ ID NO: 26488
  Purple acid phosphatase, N-terminal domain

SEQ ID NO: 26492 - DNA, 240 bp, Neocallimastix californiae
  Purple_acid_Pase_N
acttaattttggttggtattctaaatctaaggaatatccattaatccgttttggtgtttctaaagatttaactgaagaaaatgaagtaacaggtactagttatcaatgtaaaaatattgatgatgtacaatactattgtaatcaagttactgttactggattggaaagtttatcaacttattattatcaaagaaatttaaatggaaagtgggaagatgtaattgaatttaaaactaaaaa

SEQ ID NO: 26493 - DNA, 228 bp, Neocallimastix californiae
  Purple_acid_Pase_N
ttggtattcaatttcaaatgaataccctcttattcgtttcggaagtacttctgatttaactgaaaaagatgaagtaagaggtatcaattttaaatgtaaaaatattaatgatacccaatattattgtaatcatattactgttactggattaaaaagtaataccatctattattatcaaagaaatttgaatggaaattgggaagaaacaattgaatttgaaactagaag

SEQ ID NO: 26494 - DNA, 228 bp, Neocallimastix californiae
  Purple_acid_Pase_N
gcaatctttattaaatgatgataaaccaaagattcgtatatcaagcaattccaatatgtctgattataaagaatttgttggtacaaatgataattacagatacgtaaataaggatatatactaccagaataaagttactgtcactggtattgaacgcaattcggtatattattatcaaagatatataaataaaatctgggaaaatccggtagaatttaaaaccaatga

SEQ ID NO: 26495 - DNA, 237 bp, Neocallimastix californiae
  Purple_acid_Pase_N
ttttggttggtattcaactactacagaatatcctctcattcgttttggtactactaaggaattaactgaagaagatgaagttaaaggtgataattatgaatgtaaagcaattaatggtgtccaatattattgtaatcaagtttcagttactggtttaaaaccaaattctatttattattacaaaagaaatttagatggaacttgggaagagacaattgaatttaaaactaaagaccc

SEQ ID NO: 26496 - DNA, 273 bp, Neocallimastix californiae
  Purple_acid_Pase_N
tgctcttactcctggtgcagatgaaacacaacttaatttcggttgggaatcatcaactagtagtaaacctgttattcgtgtctcttctgataaagatatgaaaaattatgttgattttaatggaaagaacgaatattacagagagttagatagaaaaaaatattatgccaatcaagttactgttactggtttaaaaccaaattcagtttattactatcaaagaaaattagatgatgaatgggaagatgtagttgaatttaacacttatgattc

SEQ ID NO: 26497 - DNA, 225 bp, Neocallimastix californiae
  Purple_acid_Pase_N
ggaatctacaactgaatttgaacccagtattcgtttatctacttctcgtgacatggaaaatgctaaaatatttgatggagaaaatgaattctatagaaaaaaagatgatgttaattattattcgaataaagttacagtttcaggtttagaacctaattctgtttactattaccaaagaaaattaaataataaatgggaagacccagtaaaatttaacacctttga

SEQ ID NO: 26498 - DNA, 243 bp, Neocallimastix californiae
  Purple_acid_Pase_N
tcaattaaattttggttggtattcaacttccagcgattattctcttattcgttttggtacatccaagaaattatcagaaaaagatgaattcgtcggtagtagttatgtatgtaagaatataaaaaatgttcagtattattgtaatcaagttactgttaccggattggaacgtaattcgatttattactaccaaagaaacttaaatggtaaatgggaagatccaattgaatttaaaactcatga

SEQ ID NO: 26499 - DNA, 246 bp, Neocallimastix californiae
  Purple_acid_Pase_N
taaacttaattttggttggtattcaacccatcaagaaactccagttattcgttttggttctaagcaagatatgtcagatgctaaagaatttatgggtaatagtgaatttcatagagaattaaaaggtattagatatttttcaaataaagtgaccgttgatggtataaaacgtaaatctacctattattatcaaagaaagttaaatagtcaatgggaagaaaccattcaatttgatactcatgatcc

SEQ ID NO: 26500 - DNA, 231 bp, Neocallimastix californiae
  Purple_acid_Pase_N
tggttggtattctactactacggattattctctcattcgttttggtactacaaaatatttaaccaaagaaaatgaagttagaggtacaaattataaatgcaaagcaattaatggtacccaatattattgtaatcaagttactgttatcggtttagaaccaaattctacttattattatcaaagaaatttaaatggaaattgggaagagtcaattgaatttaaaactcatga

SEQ ID NO: 26501 - DNA, 246 bp, Neocallimastix californiae
  Purple_acid_Pase_N
acaacttaatttcggttgggaatccataactgatattgaacctgttatacgtatctcttcccgtgaagatatgaaaaattataaagattttacaggtaaaactgaatattacagagaattctatggaatgaattattattctaaccaagttaccgttaccaatttaaagccaaattcaatttattactatcaaagacaattaaatggtaaatgggaagatcctgttcaatttaatacgtatgatac

SEQ ID NO: 26502 - DNA, 273 bp, Neocallimastix californiae
  Purple_acid_Pase_N
tgctcttactcctggtgcagatgaaacacaacttaattttggttgggaatcattaactaatattgaacctgttattcgtatctcttcagataaaaatatgaaaatttataaagattttattggtaaaaatgaatattacagagaattagatggtaataaatattattctaatcaagttactactactggtttaaaaccaaattcagtttattactatcaaagaaaattagatggtaaatgggaagatgttgttgaatttaacacttatgattc

SEQ ID NO: 26503 - DNA, 249 bp, Neocallimastix californiae
  Purple_acid_Pase_N
tgaatctaaacttaattttggatggtattcttcaacaaagtcaagtccaattattcgtttttatactaataaagataaatcggaatataaggattttactggttcagtggaatattataaaaaaataaatggtaaaaaatattattctaataaggttactgtgactggattgaaacgtaataaaacttattattatagaagaagtttaaacggagaatgggaaagttccgttaaatttaaaacctatga

SEQ ID NO: 26504 - DNA, 231 bp, Anaeromyces robustus
  Purple_acid_Pase_N
gtattcagttggtaaatcatatccaaaagttcgtttaagtactgataaaaaaatgtctaatccaattgaatttgaaggtgatttagtacgtaatagaagtaaatatatcagaaaacaaggttatatgattaatagagtaactgtttctggtttagaacgtaataaaacttattattatcaagtatatatggatggagaatgggaaaaacctgttgaatttaaaacttatga

SEQ ID NO: 26505 - DNA, 246 bp, Anaeromyces robustus
  Purple_acid_Pase_N
tcaacttaattttggttggtattcaacaagtggaactgaacctgccattcgtctcagtagtaataaagacatgtctgattatactgattttattggcacagttgtttattataaaatccaaactagagtaaaatattattctaataaggttacagttactggcttggaacgtaattcaatttattattatcaaagaaaattaaatggtaaatgggaagatccagttcaatttaatacatatgatga

SEQ ID NO: 26506 - DNA, 225 bp, Anaeromyces robustus; identical to SEQ ID NO: 26474
  Purple_acid_Pase_N

SEQ ID NO: 26507 - DNA, 246 bp, Anaeromyces robustus
  Purple_acid_Pase_N
aatgcttaattttggttggtattcaacaactgaaactgaaccagttattcgttttggttctaatgaagatatgtcaaatgctaaagaatttattggtacaagagaatttgcaaaagctttggatggaaaaaattattattcaaataaagttgtagtaacaggtttagaacgtaattctatttattattatcaaagaaaattaaataatgaatgggatagacctgttcaatttaggactcaagatcc

SEQ ID NO: 26508 - DNA, 243 bp, Anaeromyces robustus
  Purple_acid_Pase_N
tatgcttaattttgcttggtattcaaaaactgaatcaattcctactattcgtttaagtacaaaagaagatatgagtaattataccgaatttactggtattaatgaatatcatagaatttatattgaagatccttattatacaaataaggtcactgttactggtataaatcgtcaatccacttattattatcaaagaaaattaaatgatcaatgggaagatccaattaaatttactacacatga

SEQ ID NO: 26509 - DNA, 252 bp, Anaeromyces robustus
  Purple_acid_Pase_N
tggagaagatgaatctatggttaattttggttggtattctactacagaatcaaatccaataatacgatttagtagtaatcaagatatgtctaatgctaaaaattttattggaactattgaaaaatatatggtattaaataataaaacttattattcaaataaagttacagttactggattagaacctcattccacttattattatcaaagaaatttaaatggtaaatgggatgaacccatttcattttttaa

SEQ ID NO: 26510 - DNA, 225 bp, Anaeromyces robustus
  Purple_acid_Pase_N
gtattcaaaaactaaaactgaaccagctattcgtgttagtaaatataaaaatatgaaaccctatgttgattttgttggtaaaatagaattttatagagaaataggtggacaatcctactattccaataaagtaactattagtggattagaacgttcatccacttattattatcaaagaagattaaataataaatgggaatctgccattaaatttaatacctatga

SEQ ID NO: 26511 - DNA, 264 bp, Anaeromyces robustus
  Purple_acid_Pase_N
atttgttggtgaagatgaatcaaaacttaattttggttggtattcaacctccaattcaaaaccaaagattcgttttggtagtaaaaaagatttgtccgatgctaaagatttcactggtacaaattcttattataagacattaaatggtaaaaaatattattcgaataaagttaccgtaaccggtttaaaacgtaaatccacttattattatagaagaaatttaaatggaaaatgggaagaaacgattagattcaatacctatga

SEQ ID NO: 26512 - DNA, 246 bp, Piromyces finnis
  Purple_acid_Pase_N
ttctcttaattttggttggtattcaactaccgaaaccatcccatccatttgttggggtactactaaagatacaagcgattgtgaagaattcaaaggtacagttacctattttaaggatttaagcggaacatcttattattctaatgctgttactgttaaaaatataaaacgtaatacaacatattattataaaagaaagttaaatggtcaatgggaaaaaccaattcaatttaaaacctatgatca

SEQ ID NO: 26513 - DNA, 258 bp, Piromyces finnis
  Purple_acid_Pase_N
cgataatgaaagtgaacttaatttcggatggttgtcccttacggataaagaaccagctattcttttcggtaaaatgaaagacctttctgatggtgaaatatttactggtagtaatacactttacagaaaaatttttgatgagagctattattctaataaagttacggtcactggattagaacgtgaatccgtttattattataaaagaaaattaaatggtcgttgggaagatgaaattattcaatttaaaacttataa

SEQ ID NO: 26514 - DNA, 318 bp, Piromyces finnis
  Purple_acid_Pase_N
atctgtttttgttggagaagatgaaacaaaaattaattttggttggtattccactcaaaattctactccaaagatccgtataggtaaaaataaagatatgagtgatgctataacttatagaggtacaactgaaattcaaattgaaagaatagattatggtggttctttctattacaatgaagataatgtattattaaatggaaaacgttatttcactcatagagttactgttgaaaatattgaacgtaataccacttattattatcaaagatatatctatggtgaatgggaagatgccgttcagtatgatacttatga

SEQ ID NO: 26515 - DNA, 261 bp, Piromyces finnis
  Purple_acid_Pase_N
agaggatgaatcccaagttaattttggttggtattctactacagaagataaacctgtaatttattggtgtaccagtgaagatttaagcaattgtgaagaattcactggtaccaatgaaaagcattacgaattacaaggtattcaatactattctaacaaagttagtgttaccaatttagatcgtaattccgtttattactacaaaagaaaattaaatggacaatgggaggaagatcttattgaatttaaaacccatgattc

SEQ ID NO: 26516 - DNA, 246 bp, Piromyces finnis
  Purple_acid_Pase_N
tatgcttaactttggttggtattctaccactaaaaatgaagtaccaactatttgttggggaacagatgaaaatttaaatgattgtaaggaatttataggaacaagtgaaaagcattataaggtcagtggaatacagtactattccaataaagttagtgttactggcctagaacgtaattctgtttattactacaaaagaaaattaaatggtcaatgggaaaagccaattcaatttaaaacctacaa

SEQ ID NO: 26517 - DNA, 246 bp, Piromyces finnis; identical to SEQ ID NO: 26516
  Purple_acid_Pase_N

SEQ ID NO: 26518 - DNA, 216 bp, Piromyces finnis
  Purple_acid_Pase_N
taaacttaattttggatggtattccactactaaaacactaccttccataagatatagtgtcaataaagacatgagtgatgccgtgcaatatgacggttattttgaacaacattataaattaaatggaacacaatactattctaacaaagtaaccattgaagatttaaaaccaaacaccgtttattactatcaacgattattaaatggagaatggga

SEQ ID NO: 26519 - DNA, 216 bp, Piromyces finnis; identical to SEQ ID NO: 26518
  Purple_acid_Pase_N

SEQ ID NO: 26520 - DNA, 276 bp, Piromyces finnis
  Purple_acid_Pase_N
ttccgttagtgttggggaagatgaatctatgcttaatttcggttggtattctaccatggatgaaattccatccattcgttatggtacggcagaagaagatgaatctcaatacaaagaatttactggtacccttcttaaacatcgtaccatcaaagataccgtctactattctaataaagttaccattactggtttacaacgcaacaccatttattactatcaaagaaaattaaatggtatttgggaacctgctgttgaatttaaaacttatccttc

SEQ ID NO: 26521 - DNA, 276 bp, Piromyces finnis; identical to SEQ ID NO: 26520
  Purple_acid_Pase_N

SEQ ID NO: 26522 - DNA, 276 bp, Piromyces finnis; identical to SEQ ID NO: 26520
  Purple_acid_Pase_N

SEQ ID NO: 26523 - DNA, 276 bp, Piromyces finnis; identical to SEQ ID NO: 26520
  Purple_acid_Pase_N

SEQ ID NO: 26524 - DNA, 537 bp, Neocallimastix californiae
  PyrdxlP-dep_Trfase_major_sub1
tatagctaatgtcgcattattcactactttagtaacaagatcagattatatattttatgattcatcaagttctaaacatgtattagatgctatatcattttcaaaagctaaaactttatcttattcacatgttaatgctattgaaaatattgaaaatcaagttaaacttgtacatgaaaaattccccaaaagtaaaaaagttattgtttcatcaagtatttttatgaatgaaggggatatatgtcaattaaaagatattcatagaattgctcaaaattatcaatgtatagttgttattgatgatacatttggttgtggtttctttgatggctcatccaataatattcttgaattttttaaatttaaaggtcaaatagattttattacaggttctttctctggaattatggaatctaatggtggttttattgtttacggagaaaatcaaaaatcatttatgaattctttaaaaataaattatgaaagagatgctattcttccaaataccgccggcgctctcctcgctagttatcaatg

SEQ ID NO: 26525 - DNA, 666 bp, Neocallimastix californiae
  PyrdxlP-dep_Trfase_major_sub1
aagaatgaaacaagctgcttatgaagctattgaacaatatggtttaagtcctcttggtagtgcaccatttggtggtttaacaaatcttcatgaaaaattaggttaccgtttaggtaaaatatatggtttaccatatggtattactacttctggtgctacccttgctaatatgactattattccattaattgttggtgctaaggatttcgttttttcagatgaattaaatcacactaccatcattgatggtattgatttatctaaagcaaaaatgattaaatataagcacaatgatatggaagatttagaaaaaaatgttaaactaattcatgaaaaattcccaaatagtgtaaaattaattattttcgatggtgtatttagtatggaaggtgatgtctgtgatttaccaaacattgttagaattgctaagaaatataattgtaaaacaatgattgatgaatgtcatgctcttggtattattggtccacacggttatggtacattagattattttaatatgccaggatctgttgattttgtaacaggtacattagttaaatctctttgttctcatggtggttatatttgctgtagaagagattatcaaaataagttagaaaattcaagcggtattattttttctacaaataatacaccagcttatgc

SEQ ID NO: 26526 - DNA, 627 bp, Neocallimastix californiae
  PyrdxlP-dep_Trfase_major_sub1
tgttataaatgaatttggatgtggtattttaaagggaattacttcatatcatgaaaagactgaagatattttaaaatctatttatcaatttccaagttgctataccctttcaggagatggaaattcttttattattccattaatagtcggaaaaaatgatgcaatatttattgatgaatgtgctaaaacatcaattaatgacagtgctgaattatcaaattcaaaaatttattattataagcataataatgcttctggtcttgaagcttgtcttttgaaggccagtcaggaattaccaaatagtaagaaacttattattatagaaggtgtatataatattactggtgaaatttcaaatttagttgagtttataaatgtctcaaaaaaatttggaggcattgtgttagttgatgaaagtcatgctcttggtgtacttggaaaagagggtaagggttcattagaatatgcaaatattcatgaaggtgttgatgtaattactggttcattagaatattcactttgttcaaatggatcatacattcttttaaataatgaattaagtaaacaatttaatgatttaatatttataaatgatacaattactccattaagtgctgctatttcaag

SEQ ID NO: 26527 - DNA, 666 bp, Neocallimastix californiae
  PyrdxlP-dep_Trfase_major_sub1
tgaaagagtgataaaggaatatggtataggatcctatggtatttttacaccatatcatgttgaattatatcaacatttaaaggaaatttatggtgaagattatgatcatattcaaacctatcagggagatatacgtgatgtcttcttctcaaaattatttgattccaacgatttcattttctatgatgaacaattaaacagctcattcagacaagtcttgagagcattacatttcaagaagaatcaactcgttgaatttaatcataatgatgcatttgatctttctgaaaaattagaagctattgatttaatttcacctgatgctcataaatatattatcacggaaggtgtttttgaattacaaggggatttatgtcatcttcaagatattttcaatatttcaaaaaaatatgattgttatgttattttagatgaatccaatgccttaggtgttattggtaaggaaggattgggttcctacaattatcatcaatgtcaggaaaaggcagatattgtattttgctctatggataaggtgctttgtgccagtggtcaattttatgtatttaaccaaagaatttcaactctcctagcaagacgtctcactgaccttttcaatgaaacaatttatccaccagtaagtacattagctgctgctgtcgctaa

SEQ ID NO: 26528 - DNA, 678 bp, Anaeromyces robustus
  PyrdxlP-dep_Trfase_major_sub1
taaaaaggcagctgtagaagctattgaattatatgggttaaatgctgataatcaatgtccattaaaaatacagttagaaaaaaaattatcaaatgaatatgattatccatattctactgttttttctggagccaatatttgtaatgttgcattatttactacattggcaacaaaaaatgattatattttttatgattcatcaagttcaaaacatgtattagatgcaatttcattttcaaaagccaaaatattatcttattcacatgtaaacgctatagaaaatttagaaaaacaagttaaaatcgttcatgaaaaatttccaaatagtaaaaagattatcgtttcttcaagtgtatttattaatgaaggagatatttgtcaattaaatgatattaataaaattgctcaatcttatcaatgtattgtagttattgatgatacatttggatgtggttattttgatggttctgctaataatattcttgaattttataaattaaaaggtcaaattgattttatttgtgggtctttttctggtattatggaatccaatgggggattcattgtttatggtgaaaatcaaaaatcatttatggatttaataagtaaaaattatgaaagagatgctatcttaccaaatatagctagtgctattttagctagttatgaatgtttaga

SEQ ID NO: 26529 - DNA, 468 bp, Anaeromyces robustus
  PyrdxlP-dep_Trfase_major_sub1
aatttttattaatgaaggatctaaaacatcaataaaagatggagcagaattatcaaatgcaaatgtctattattataaacataatgatatttcaagtcttgaagctagtcttgtgaaggctaatcaggaattaccaaatggtaaaaaacttataacagttgaaggggtatatgaaataacaggggaagttgttaatttaagtgaatttattacagtagctaaaaaatatggtggtttagttttattagatgaaagtcatgcacttggtgttcttggtgctaaaggtaaaggttcaatggaaaatgctaatattcatgatggtgtagatattattactggttcattagaatattcactttgttcaaatggttcatatttccttttgaatcaaaatttaagtcaacaatttagtgatttaattttcattaatgatattattactccattaagtgccgctatttctagtac

SEQ ID NO: 26530 - DNA, 630 bp, Piromyces finnis
  PyrdxlP-dep_Trfase_major_sub1
agttattaatgaatttggttgtggtatttttagaggattaacaacatatcataagaaaactgaagatattttaaaggccatttatcaatttccaacatgctatacgctttctggagatggaaattcatttgttattccattaatggttggtaaaggggatgctatttttgttgatgttgaagcaaagacttcaattaaagatggttcagagttatcaaatgctacagtctattactatagccataacgatccaattagtcttgaatcatgtcttttaaaggcaaatcaagaagtaccaaatggtaaaaagcttgttgttattgaaggtgtttataaaatatctggtgatgttgctaaattaaatgaatttattccaattgccaagaaatatgacgctactattttagtagatgaaagccatgcacttggtgtacttggtgctagaggaagaggttcattagaacaatttaatgttcgtgagggtgttgatattattactggttcattagaatattctctttgttctaatggatcatattttcttttaaataaacaattaactcaacaatttagtggctttatctccattaatgatacaattactccattaagtgctgccattgctagtac

SEQ ID NO: 26531 - DNA, 663 bp, Piromyces finnis
  PyrdxlP-dep_Trfase_major_sub1
taaacttgaagcagaaaaagctattaaagaatatggtttaggatcttacggtatttttactccttatcatgcggaattaacggaatatatagaaaaaatttatggggaagattgttctattcgaacttttcaaaatgatatacgtgatattttatttaatagtttggttagttctcaagattttattttcattgacgaacaattgaacacttcttttaaacaaacaataaaatcattattcttagaaaagggtcatattattgaatatactcataatactccacttgaccttaaatctcaattaaaagcaatccaattaaaatttccaacagtaaataaatttataataaccgaaggtgtttttgaaaatataggggatgtttgttatcttaatgatattatggatatatcaaaagaatttggatgtactcttgttttagatgaatcaaatgctttaggggttatcggtcaaaaaggatttggttcatatgactatcaccaatgtcaacaaaaagcagatattattttttgctctatggataaaacactctgttctagcggtcaattttatgtatttaataataaaagtattagtatattattaaaaaataatactagtctctttgatgaatccatatattacccaataaatgcattatcagc

SEQ ID NO: 26532 - DNA, 597 bp, Piromyces finnis
  PyrdxlP-dep_Trfase_major_sub1
agttaaaaaagcagctatagaagctattgaaaaatatggtttaaattcagatatacaatgtccattaaaaatacaattggagcaaaaattatcaaaagattatggatatcaatatgctgctacattttctggcgccaatgttgcaaatatatcattgtttaccacattagtaacaagaatggattatatattttatgattcttcaagttcaaaaaatgtaatagatgctgttttattttcaaaagcaaaaacattatcatattcacacgctaatgctatagagaatttagaaaaacaagttaaattagttcatgaaaaattcccaaaaagtaaaaaagtcattgcttcatcaagtatttttgtaaacgaaggtgatatatgtcaattaaaagaaataaatagaatagctcaaacttatcaatgtatagttgtaatagatgatacatttggttgtggtttctttgatggttcatcaaataatatacttgaattttataaattaaaaggtcaagttgattttataacaggttcattttcaggaatcatggaatcaaatggtggatttattgcatatggtgaaaatcaaaaggaatttat

SEQ ID NO: 26533 - DNA, 666 bp, Piromyces finnis
  PyrdxlP-dep_Trfase_major_sub1
aagaatgaaagaagctgcttataaagctattgaacaatatggtttaagtccacttggtagtgcaccatttggtggtttaaccaatcttcatgaaaaattaggataccgtttaggtaaaatttatggattaccatatggtatcactacttcaggagctactcttgctaatatgactatcattcctttaattgttggtgcaaaggatttcgttttttctgatgaattaaatcatactactattattgatggtattgatttatcaaaggctaaaatgattaaatataagcataatgatatggaagatttagaaaaaaatgttaaattaattcatgaaaaattcccagatagagtaaaattaattatttttgatggtgttttcagtatggaaggtgatgtatgtgatttaccaaatattgttagaattgcaaagcaatacaattgtaaaactatgatggatgaatgtcatgctcttggtattattggtcctcatggttatggtactttagattacttcaatatgccaggatcagtcgattttgttactggtactttagtaaagtctctttgtgcccatggtggttatatttgttgtagaagagattatcaaaataagttagaaaattctagtggtattattttctctacaaataatactccagcatatgc

SEQ ID NO: 26534 - DNA, 276 bp, Neocallimastix californiae
  PyrdxlP-dep_Trfase_major_sub2
tcgtcgtcttcaactctttaaaaatattcttcattggaaaaatggattaaagcgtattggattagatataccaaatcattccaaatcaacagtcattcctatttttatgccaacaaatgaatctggaatcgctgttcaaaaggcattacaaacccaaggattatatgtttcctatgaatccaatgaaaaagatgttcaacaccactataaaattattacttccattcaaactcgtatgacaagtgatgaaatagatcaagccttagaaattatggg

SEQ ID NO: 26535 - DNA, 330 bp, Neocallimastix californiae
  PyrdxlP-dep_Trfase_major_sub2
tgctacttcattaaaggctctcgatttaattgaagaagaaggtccaaatagtgttcgtgctagacttcaacgtaatgtcaagcattggaaagaaggtgttcgtaacctcggttttgaaattattgaaggtgtcagttgtgtttgtccaattatgatttatgatgaaattaatggtttaaagtttcaaaaacgtttatatgaagaaggtttgaatttctcagctgttgctttcccagctgttccaaagaatatggctagattaagaactactgttttaggttcactcactgatgaagatattgatgaagctttaagtattttaggacgtgt

SEQ ID NO: 26536 - DNA, 291 bp, Neocallimastix californiae
  PyrdxlP-dep_Trfase_major_sub2
tacaacattagatattttaagacaggattcgaagacagttgatcaattaaaaaataatgtatcatggtggaggagtcattgccaacaaaatggtatagaattaattgatagtaattcagctatttctgcaattagaattgatgataagggtattttattaaatcttcaaaggagattatatgatgaaggattaaatgttatggtaagtacaaggccatatggtttattaaaattcattctttctgcctcattaactgaagatcttttagaagaagctatggatatattatt

SEQ ID NO: 26537 - DNA, 288 bp, Anaeromyces robustus
  PyrdxlP-dep_Trfase_major_sub2
tactttagaaattttaagacaagatgcaaaaatgattcaacaattaaaagataatatttcatggtggagaagtcattgtcaacaaaatggtattgaattaattgatagtaattcagctattgctgctataagaattgatgatgactctgttttattaaatcttcaaaaaagattatatgaagaaggattaaatgttatggttagtaacaatccatatggtttattaaaatttattttttctgcttcattaactgaagatcttttagaagaagctatggatattttatt

SEQ ID NO: 26538 - DNA, 288 bp, Piromyces finnis
  PyrdxlP-dep_Trfase_major_sub2
tacattagatattttaagacaagatactaagatgattgaacaattaaaaagtaatatttcatggtggagaactaattgtcaacaaaacggtattgaattaattgacagcacatcatcaattactgctattaaaattgatgacgaaaatgttttattaaatcttcaaaaaagattatttgaagaaggattaaatgtaatggttagtacaagtccatatggtttattaaagttcatactctctgcttctttaactgaagatcttttagaaaaggctatgaatattttatt

SEQ ID NO: 26539 - DNA, 351 bp, Piromyces finnis
  PyrdxlP-dep_Trfase_major_sub2
tgctgttgctaaaacagtcttaaatataatttttgaaaatactacagattttaaaaatataacatcttccatagatgttcacactcaactagttgataatattaattattggaaacaaaaatgtcaaagtattggcttaaaattaattgacagtccttctgcaattacttcaattattattgatgatgtagatgctgaatctttagttgaacttttatttaaaaataatataaaatgttcatttaccaaacaaataaatcataatattaatacaaatattttaaaattcaatatattaagatcaatgactaaaaaattcataaatgaagcctttaacattttacaatcagt

SEQ ID NO: 26540 - DNA, 285 bp, Piromyces finnis
  PyrdxlP-dep_Trfase_major_sub2
cactagacgccatcaactttttaaaaatattcttcaatggaagaatggtttaaaaggtataggtttagacgttccaagtcattcaaaatcagcaaccattccaattttcatgccaactgatgatgcaggaatcgcttttcataaagcattacaggaacaaggtttatatgtatcatatgaatctagcgaaagagatgctatacataaatataaaatattaaccactgttcaagcaaataaaaccaaagatgaaatagatagtgcattaaaaattatcggtcgtgt

SEQ ID NO: 26541 - DNA, 330 bp, Piromyces finnis
  PyrdxlP-dep_Trfase_major_sub2
tgctacttcattaaaggcccttgatttaattgaagaagaaggtccaaatagtgttcgtgctagacttcaacgtaatattaaacattggaaggatggtattcgtaatcttggttttaagattattgaaggtgtcagttgtgtttgtccaattatgatttatgatgaaattaatggtcttaaattccaaagacgtttatatgaagaaggtttaaacttctcagctgttgcttttccagctgttccaaaaaatcaagctagattaagaactactattttagcttcacttactgatgacgatattgatgaagctttaagtattattggacgtgt

SEQ ID NO: 26542 - DNA, 444 bp, Neocallimastix californiae
  Rhamnogal_lyase
tgtcagtttgacacaaaacaataactcatatattttaaaaaataactatgctaccgtggttatttctaaaaaagatggttatattacttcattaaagattgctggtgacaatcaagaatttttaaatagagcttatattgatgctaatggttcaaaagctggctttcatgcaaaaaaaagtacaattattaagaataccaatgatcatgttgaaattgcattcactgataatgtattaaatatggattgggaagttagatatactatgcttaatgatactaagggtgtttacttctcattaaaacttgaccataaagcaagctatgctgatacacaattcagtgaaatacgtttagtttttagattaaagagtaatccattcaattggttacaaattgaagataatgttggtcgttacttaccaactgctgaagaacaaaagaa

SEQ ID NO: 26543 - DNA, 510 bp, Anaeromyces robustus
  Rhamnogal_lyase
cgctaaagtaaatttaactgaaaacaatacttcctatatattatcaaatggattagcaacttttacaattgctaaaagttctggttttattacttctatgaagtataaaaacaattctcaagaattcttaaacagatcttatattgatgctaatggaggaaaagtttatttctctgttactagttcttcagtagttataagaactgatgatttagttgaaattgtattttatgatgactattccaagcatgtaggcactggttttgctattgattgggaagtcagatatactatgagatctggtgtttccggtctttatttctctttaacacaagctcataaatctaattacgaagaagctcaatgttctgaattaagacttgttatgcgtttaaagagtgatgttttcaattggttacaagttgatgatttcactaagagagttatgccaactgctgctcaacaaaacaaatgtactactctttctccacaagaagcttgtcaattaga

SEQ ID NO: 26544 - DNA, 501 bp, Piromyces finnis
  Rhamnogal_lyase
tgcaagtgttactttaactgaaaataatacttcatacattttatccaatggattagcaacatttacaattgctaaaagttcaggttttattacttcaatgaagtataaaaacaactcacaagaatttttaaatagatcttacattgatgctaacggaggaaaagtttatttttctgtaacaagttcatatgtagccactaaaaatagtgatttagttgaaattgtttttgttgatgattattccaaacatgttggtactggatttgctattgattgggaagttagatatactatgaaatcaaatgtttctggtatctatttctctttaactcaatcacacaaatctaattatgaagaagcacaatgttctgaattaagactagttatgcgtttaaagagtgacgtatttaattggttacaagttgatgactttaataaaagagttatgccaactgcttctgaacaatcaaaatgtgttactctttcaccaagtgaggcgtg

SEQ ID NO: 26545 - DNA, 498 bp, Piromyces finnis
  Rhamnogal_lyase
ttctcttactgataatggaagttcatacatattaagaaatgattatgccattgttacaattgcaaagaattccggttatattacttccttaaaattaaatggaaataatcaagaatttttaaatagatcttatattgatgctaacggtggaaaagtttatttttcaccacaaagtagcaaagtaataaaaaatacatcctcacatgtagaagttgctttctatgataattataattctaattcaaaattaggacttgattgggaagttagatacactatgctctctgatacaagaggtgtttactattcattaactaatactcacaaaacaaattacccagaaacatcatatagtgaaattcgtttagtactcagattaaaggcagatattttcaatcacttacaagttgaagatgatgtataccgtgatatgccaagcgctgctgatcaaaacaaatgtgttgaaatgggaccaaaagaagcttgccaattaccaaa

SEQ ID NO: 26546 - DNA, 792 bp, Neocallimastix californiae
  RhgB_N
gacacaaaacaataactcatatattttaaaaaataactatgctaccgtggttatttctaaaaaagatggttatattacttcattaaagattgctggtgacaatcaagaatttttaaatagagcttatattgatgctaatggttcaaaagctggctttcatgcaaaaaaaagtacaattattaagaataccaatgatcatgttgaaattgcattcactgataatgtattaaatatggattgggaagttagatatactatgcttaatgatactaagggtgtttacttctcattaaaacttgaccataaagcaagctatgctgatacacaattcagtgaaatacgtttagtttttagattaaagagtaatccattcaattggttacaaattgaagataatgttggtcgttacttaccaactgctgaagaacaaaagaattgtgaagtaatgggtccaaaggaagcttgtaaggttaaaactggtgaagttcttcacaagtacgattggtctattgatgctttaaaacatgatgttcatggtttctctactaaaaatggtttaggttgttggtttgtccttccatctatggaatggaagaatggtggtgcctacaatcgtgatcttgcctgtcacaatggtgaaaatgattccatacaaattatgtacatggctggttctcactatggtgctggtgatgaatacccaaagaagggtgaaaattggtcaaaggtttacggtccatatttaatttatgtaaataaagctggttctccacaagcctcatggaaagatgc

SEQ ID NO: 26547 - DNA, 705 bp, Piromyces finnis
  RhgB_N
tactgataatggaagttcatacatattaagaaatgattatgccattgttacaattgcaaagaattccggttatattacttccttaaaattaaatggaaataatcaagaatttttaaatagatcttatattgatgctaacggtggaaaagtttatttttcaccacaaagtagcaaagtaataaaaaatacatcctcacatgtagaagttgctttctatgataattataattctaattcaaaattaggacttgattgggaagttagatacactatgctctctgatacaagaggtgtttactattcattaactaatactcacaaaacaaattacccagaaacatcatatagtgaaattcgtttagtactcagattaaaggcagatattttcaatcacttacaagttgaagatgatgtataccgtgatatgccaagcgctgctgatcaaaacaaatgtgttgaaatgggaccaaaagaagcttgccaattaccaaacggagaagttattcacaaatatgattggtctgttgatatgttaaaacatcatattcatggtttctccagtaaatcaactggtttaggttgttggtttgttattccatcattagaatggaagaatggtggtgcatacaaccgtgatctttcttgtcaccaaggtggtagtgattcattacaaattatgtacatgaatggttcccactatggtgg

SEQ ID NO: 26548 - DNA, 408 bp, Neocallimastix californiae
  RICIN
gtactatattaagaacactggatctgacaagtaccttcaagctaatggttctagtgctggtgccaatgttgaaattggttcattcactggttattccgatcaaaagtggaaggttactactaatggtgaaggttacattactttacttaatggtaatggaaactttaacttagatgttgatagtgctaagaatgaaaatggtgccaacattttaatttatgatgcttacggtggtgttgcccaacaatttgctcttactgctggaagtggtaattcattcattattactacaagagttagtaatggtggaaaggctatcgatgtttacgaaaacagaactaatgatggtgctaatgtctgccaatggtctgttaatggaaactcaaaccaaacttgggtcttcgaaag

SEQ ID NO: 26549 - DNA, 408 bp, Neocallimastix californiae; identical to SEQ ID NO: 26548
  RICIN

SEQ ID NO: 26550 - DNA, 408 bp, Neocallimastix californiae
  RICIN
taattattacattaagagtaatttcgccaataaatatcttgttgttagggatggtagaggtgccaatgctcaaaatgttgaaattggttccactaagcaaaaatggaaaattacaaataatgatgatggtacagtttatattgtaagtgaatttggtaatttctctttagatgttgatagaggttccggtgacaatggtgccaacattcaaatttattctcatcacggaggagaagctcaaaaattcattattagagaaactaatcaatctggcgtttatgttattgatactcaagctagtaatggatatagagctcttgatgttgaaggtgagagaacttctgaaggtactaatgtttgtcaatgggatgattccggtaagagtaatcaaacttggacttttgaatc

SEQ ID NO: 26551 - DNA, 405 bp, Neocallimastix californiae
  RICIN
caagattaagaaccccgtttccggtttataccttcaagttgccaatgctgaaggggccgacgctcaaaatgttgaaattggtactgactctgaacagatgtggaagcttaccaatcttggagataactacgttaccttaaccagtagtctcggtaatttcaacttagatatctgtatggctgaagatgaaaacggtacgaacgctcaaatttacaccgttcacaatgaagatccacaaaaattcgttattatggaaacgaaagacaaggatgtttacgtcatcggtacgaaaggtagtaatggttataaggttcttgatgttgaaagttatggtactactccaggaagtaacgtttaccaatgggaaaatgaaggtaaggacaaccaagtttggactttcgaact

SEQ ID NO: 26552 - DNA, 405 bp, Neocallimastix californiae
  RICIN
ttggtattacattacaaatactaattcaaataagtatcttagtgttagaaatggtgttggagctaatagtcaaaatgtcgaacttggttccactcaacaaaaatggaaacttaccaacaacagtgatggatcagttactttagttagtgaagttggagactttgctttagatgttagtggtggttcttctgataatggtgctaatgttcaaatctactctaactatggtggagatgcccaaaagttctatatcagagaagtttcatccaacgtctatactattaccactaaggtaagtaatggtgaaaaggctcttgatgccgaaggtgccagaacttctgacggtactaacattttacaatggacagatgaaggaaagagtaaccaaacttggacttttaaatc

SEQ ID NO: 26553 - DNA, 405 bp, Neocallimastix californiae; identical to SEQ ID NO: 26552
  RICIN

SEQ ID NO: 26554 - DNA, 417 bp, Neocallimastix californiae
  RICIN
ttggtattacattaagaatccaagcactggaaagtacattcaagttgaagatggtgttggtcgtaatagtgctaatgttgttattggttctgaacgtaaggatgatgcccaaaagtggaaggttactaacactaatggttatgttacctttacatctgctcttggtaattatatgattgatattgccaatggagaagatagaaacggagccaatgttcaaatttatgatgcctacggtggtgatgctcaacaattcattatctacaagactggtagagaaaatgtttacactattggtactaaggcttctgcaggagataaggctattgatattgaaggagcacgtaatggtgaaaacgttaatctcttacaatggactaatgaatataaggataaccaaacttggtcctttgaaaa

SEQ ID NO: 26555 - DNA, 405 bp, Neocallimastix californiae
  RICIN
gtattacattaaaaatactggatctggtaaatacctcaatgttaaggatggtaaagctgcttctactcaaaatgttgtaattggttcttctaaacaaaaatggaagcttaccaacaacagtgacaataccgttactttacttagtgaagttggagatttcatgttagatgttaatggtggcagtagtgataatggtgccaatattcaaatttacaatgcttatggtggagatgctcaaaaattcgtcattagagaaacttctcaagctaatgtatatgttgtcagtactaaggtttcaagtggttacaaggttcttgatgttgaaaatgaaggtaaatacgatggtagtaacatttgtcaatgggaaaatggtgaaagaagtaatcaaacttggacttttgaatc

SEQ ID NO: 26556 - DNA, 408 bp, Neocallimastix californiae
  RICIN
atggtattacataaaaaacccaagttcaggaaaatatcttgttgttaaagataaaaagggtgctgcttctcaaaatgttgaaattagttcttctaagcaaaaatggaagcttaccaacaataatgataataccgttaccttacttagtgaagttggagatttcatgttagatgttaatggaggtagtgacaagaataatgctaatattcaaatttatcatgcttatggtggagatgctcaaaaattcatcattaaagaaacttcacaaagtaatgtatatgttataactactaaagtttctaatggtagcaaagctcttgatattgaaaaggaaggtaaaaacgatggtagtaacgtcttacaatgggataatggtacaaaaagtaatcaaacttggatttttgaatc

SEQ ID NO: 26557 - DNA, 405 bp, Neocallimastix californiae
  RICIN
gtattatattaagaacactggttctggtaaataccttactgttaagggtggtgtagctgttgcaggtcaaaatgtagaaattggatctactaaacaaaaatggaagcttaccaacaatgatgacaatactgttactttacttagtgaagttggagatttcatgttagatattgacagaggtcttgaagaaaatggtgctaatattcaaatctaccatgcttacggtggagatgcccaaagatttatcattaaagaaactggtaagtctaaggtttatgtcatcagttctaagattactaatggttacaaggttcttgatgttgaaaatcaagcaactgctgatggtagtaatgtttgtcaatgggaaaatggtgaaagaagtaatcaaacttggacttttgaatc

SEQ ID NO: 26558 - DNA, 411 bp, Neocallimastix californiae
  RICIN
tggttggtataccattaaaaatccagaatctggtaaatatcttcaagtaagtaatggaagagcttctgatagtgctaatgtagttattggtaccaatgctcaaaagtggaaacttgaaaatgttggaaacggttacgtaactttagttagtatgtatggtaactacatgttagatattgctaatggagaagataaagatggttctaaccttcaaatatactctgcttatggtggtgatgctcaacaatttataattttgaagactcctcagaataatgtatatgcaattggtactaaggctagtgaaggtactaaagtacttgatattgaaggtggaagaacatccgaaggttctaatgttttacaatggactaatggcggaaagagtaatcaaacttggacttttgaatc

SEQ ID NO: 26559 - DNA, 408 bp, Neocallimastix californiae
  RICIN
gtactatattaagaacactggctctaacaagtatctccaaactgttggttccactgctaattcaaatgtagaaattagttcattcactggttctgctgcacaaaaatggaaggtaactaagaatagtgaaggatacattacattacttaatggtgttggtgatttcaatttagatgtagccaacggtaagaatgaaaatggtgtaaatattttaatttatatcgcttatggtggtgaagctcaacaatttgctctctctgctggaagtaacaattctttcattatcacaactagagttagtaatggtgataaggccttagatgtatatgaacacagaaccgaagatggtgcaaatgtttgccaatggacaacttcaggtaaaccaaaccaaacttgggtattcgaaaa

SEQ ID NO: 26560 - DNA, 405 bp, Neocallimastix californiae
  RICIN
gtactacattaagaatactggttctaataaatatcttactgttaaggatggtagaggtgctagttctcaaaacgttgaagtcaattctagaaaacaaaaatggctacttactaatgttggtgatgatgaagttactttaactactgaacttggtaattatatgttagatgttaattctggtagtgaaaataatggagcaaacattcaaatctataatagtcatggaggagattctcaaagattcattattgaagaaacttatcaaagtgatgtttatgtcattggtacaaaggtaactaatggttataaggttattgatgttgaaagagaaggtaaggacgatggtagtaatgtttgtcaatgggataatggtgaaaaaccaaaccaaacttgggtattcgaatt

SEQ ID NO: 26561 - DNA, 411 bp, Neocallimastix californiae
  RICIN
tggtaagtacaacatcgttaatcgtaacagtggtaagttcttaggtgttaacaatgactctacttctgatggtgctaatgttcatcaatggtctgacaatggaaagactagtgaacaatggattatcagtgatgaaggtaatggttacaagattcttaatgtcaatgccaataaggttcttgatgttaacgatgcttcctattctgatggtgccaatgttattctctggagcgataatggtaactctaaccaacgttggattattcaagaacttggtgatggatatgtcactattgaaaactataacagtggtaagaaccttgatgttgaaaagtcatctacttctgatggtggtaatgtcttacaatggagtaacaatggtcaaaacaaccaacaatggaagttagttcg

SEQ ID NO: 26562 - DNA, 405 bp, Neocallimastix californiae
  RICIN
gtattatattaagaacagtagttctggtaaatatctttctgttagaaatggtgttggtgctaatgcccaaaatgttgaaattggttcttcaaaacaaaaatggaaggttacaaaaaataatgatggttccgttgtaataatttctgaatttggtaacttcgctttagatattgcaaatggttctggagataatggagctaatgttcaaatttacactactcatggtggtgatgctcagaagtttattattagagaaacttctaactctggtatattcgttattgatactattgctagtggtggttctaaagctttagatattgaaggtggtcgtagtgctgatggtactaacatttgtcaatgggatgattctgcaaagagtaatcaaacttggacttttgaagc

SEQ ID NO: 26563 - DNA, 408 bp, Neocallimastix californiae
  RICIN
aggtacatataaattaattaaccgtcgtagtaacaaggctttagctgttcaaaatgactccaaggataacgctgctaacgttgttcaatggactgaaagtaataaaactagtcaacaatggaagattactgaagatggaggttacagaatcttaaatgtcaatgccgataaagcccttgatgttgaaagagattcaactcaaaatggtggtaatattatcatttggcctgataccggtaacctcaatcaacgttggactattgaagatgctggaaatggttatgttgaaatcgttaatcttagtagtggtaaagctcttgacgttgaaaatgaatccactgctgatggtgccaatgtttgtcaatgggatgctcatggtagtcaaaaccaacaatggaaattagttcc

SEQ ID NO: 26564 - DNA, 408 bp, Neocallimastix californiae
  RICIN
tggtacctaccgaattattaatcgtaacagtggaaaagctttatctgttgttaatgattccaagaataatgcagctagtgtggttcagtatacttacacgggtaagagtagtcaacaatggaagattgttgaagatggaggttacagtttcaccaatgttaattctaataaagtacttgatatgaatggagcctctcttgaagatggaggtaatgctattatttggccagatattgctggtccaaatcaacgttggtctattgaaaatgctggagatggttatgtctatattattaactttaatagtaataaagtccttgatgttgccaatgtttcaaaggaagaaggaggaaatgttcatcaatggaccatcacaaatggtgccaatcaacaatggcaattaattcc

SEQ ID NO: 26565 - DNA, 411 bp, Neocallimastix californiae
  RICIN
tgacagatacaagatcattaatcgttacactaacagagttttagctgttgaaaacgattccaccgctaataatgccaatgttctccaatggggtgacaatggaagttccggtcaacaatgggttgttgctaaggaaggtgatcaatacagaattactagctatactaccaacaaggccttagatgtcagtggaagatcaactgccgatggtggtaatgttattatttatgatgataaggctcaaggtaatcaacgttggaagtttattgatgccggtgatggttatgttatcattgaaaatgtaaatagtggaaaggttcttgatgttgataacgcctcaaaggaatatggtgctaatattatgcaatggagaaagaatggtagtactaaccaacaatggaaattagttcc

SEQ ID NO: 26566 - DNA, 420 bp, Neocallimastix californiae
  RICIN
ttggtacttcatcaagaatccaagatctggtttatatcttcaagttagtaatgattatgctagagcttctgccaatattgaaattggtactggaacaaaatctgatggtcaaaaatggaaagttacaaacgttggtgatggatacattactttaactactgctcttggtgacttcaatattgatattgccaatggtgatgataaaaacggagccaatgttcaaatctatgatgcctacggtggaaatgctcaacaatttgttgttatgactacttctgacagtaatacctatactataggttctaaggtcagtagtggtggtaaagctcttgatattgagaatgaaagtacctcagatggtgccaacgtttgtcaatggacaaacagtagtaagggtaaccaattatgggtctttgaaaa

SEQ ID NO: 26567 - DNA, 417 bp, Neocallimastix californiae
  RICIN
ggatggttggtatactatcaagaacacaggttccggtaaatatcttaatgtagattatggtagagctagtgctggagctaatgttgttattggttctgatgctcaaaagtggaaggttgaaaacaacagtgaaggttatgttactttagtatctatgtatggtaattacatgttagatattgccatgggtgaagataagaatggagcaaacattcaaatttacgatgcttatggtggagacgcccaacaattctctcttattgaaacttctaagaagggagtttacgttattgctacaaaagttagtcaaaatgataaatgtcttgatgtcgaaagtgctagtaccgcagaaggtagtaacgttttacaatggacaaacggtggtgaaagaagtaatcaaacttggtctttcgaatc

SEQ ID NO: 26568 - DNA, 414 bp, Neocallimastix californiae
  RICIN
agatggatggtatacaattaaaaatactggatctggtaaatatcttcaagttcaaaatggtagagcttcagatagtgcaaatgtagttataggttccaatgctcaaaaatggaaaattcaaaatattggagatggctatgttactattctttccatgtatggtgattatatgttagatgttgccaatggtgaagatgtagatggtgctaatgttcaaatttattcttcctatggtggtgatccacaacaatttattattgctgaaacttcaagaagtaatgtatatgttattggtagtaaagttagtgaaggtaataaggttattgatattgaacatgaaagtactgaagaaggtagtaatgttcatcaatggactaacagtgaaaagagtaatcaaacatgggttatagaatc

SEQ ID NO: 26569 - DNA, 411 bp, Neocallimastix californiae
  RICIN
tggtaaatacaagattgttaaccgtaacagtggaaaagttttagctgttgttagtgattctacttcaaatggagctgatgtcattcaatggtctgataatggaaagactagtcaacaatgggtcatcacagatgaaggcaatggttataagattatgaatgttaatgctaataaggctcttgatgtcagtgaaaattcagtgaaggatggtggtgatgttattatctggagtgataatggccataataaccaacgttggaatatccaagatgttggtaatggttatgttactattaaaaacgtcaacagtggtaagaaccttgatgttgagaaggaatctacctctgatggagctgatgttatacaatggggtaataatggtaacagtaaccaacaatggaaattagttgc

SEQ ID NO: 26570 - DNA, 411 bp, Neocallimastix californiae
  RICIN
tggtaaatacaagattattaaccgtaacagtggtaaagctttaggtattgatggtgattctacttcaaatggtgccaatgttattcaatggtctgataatggaaagactagtcaacaatgggtcatcacagatgaaggcaatggttataagattatgaatgttaatgctaataaggctcttgatgtcaatgataattcaatgaaggatggtggtaatgttattatttggaatgataatggtaataataaccaacgttggaatattcaagatattggtggtggttatgttactattgaaaacgtcaacagtggtaagaaccttgatgttgaaaagggatccacctctgatggaggtaatgtattacaatggggtaacaatggcaacagtaaccaacaatggaaattagttgc

SEQ ID NO: 26571 - DNA, 402 bp, Neocallimastix californiae
  RICIN
agaagagtatcgcattgcaattcaactcagtggaaaatatataacagctgccaataatggaaatgttcaccaatgggaaaatttaaatgataattctcaagtttggtattttgaagatgcaggtaatggaaaatttgctattctttcaggaaaaaatagaaaattagccatgacggttgaaaatggtgattctaaaaatggtaataatattcttcttactgaatataaaaatactgctgctcaacattttattctccatggagtagatgatgcgtactatattactgccgaatgttccggtaaagcctcactcgatgtttataatcagagttatgataatggtgctaatattgatcaatgggcttactggggaggtgaatgtcaaaagttctatataatacc

SEQ ID NO: 26572 - DNA, 420 bp, Neocallimastix californiae
  RICIN
atggtattttattaaaaattcaagttctggaaaataccttcaggtaagtaatgaaaattctagagctgcttcaaatattgaaattggttctagtcgtaaatctgatggtcaaaaatggaagctaactaatgttggtgatggttatgttactctaacttcagctctcggtaattttaatgttgatgttgctaatggagaagataaaaacggtgctaatattcaaatttatgatgcttatggtggtaatgctcaacaatttattattatgactacttcattctctaatgtttatactatcggaaccaaagttagtaatggtgaaaaggctcttgatgttgaaaatggaagtaaatctgatggtgccaacgtaattcaatggaaaaatgaaagtaaggataatcaaagttggatttttgaaaa

SEQ ID NO: 26573 - DNA, 405 bp, Neocallimastix californiae
  RICIN
aaaagattatatgattatgtcacatcttagtggaaaatatataacaatagctaatgatggaagtattcatcaatgggaaaaacttagcgacactaaatctcaagtatggcgctttgaaagtgccggtaatggaagattcgctattctttcaggaaacaacgccttaactgtagaaaatggtaataataaagatggtaataaaattattttatcacaatatcgtaaaacatccgctcaacatttcattcttcacaaaactgatggtaattatgatacctactatattactgctgaatgttctggtaacgctgctttagatgtttatgatcaaagctctgataatggagcaaaaattgatcagtggaattattggggtggagataatcaaagattttatattattcc

SEQ ID NO: 26574 - DNA, 411 bp, Neocallimastix californiae
  RICIN
ttggtacttcataaagaacccatctactggtaagtatcttactgcttctggtaactcagttccattcaatgtaattattagtaccggataccaagaagacaatcaaaagtggaaggttactaacgctggtaatggttacattactttaactagtggtcttggtgactatatgttagatgttgccaatggttctgctaataatgatgctaacattcaagtttatagtgcctatggaggagatgctcaacaattcaaacttgttgaatacggtagtggtgaatttgctattgttactaagtctagtaacgatggtaaggctgttgatattgccaacaacggttacactgatggtactaatgttttacaatggactaacagtggtaagagcaaccaaatttgggtattcgaaaa

SEQ ID NO: 26575 - DNA, 420 bp, Neocallimastix californiae
  RICIN
atggtattttataaaaaatccaagttctggtaaataccttcaagttgctaacgaaaatggtaaaaatgttgccaatattgaaatcggtacaggcagacaatctgatggtcaaaaatggaaacttactaatgttggtaatggttatgttactttaacttcagcccttggtgaattcaacattgatattgccaatggagaaaacaaagatggaactaatgtacaaatttatgaagcctatggtggtgaagctcaacaattcgttattttaactacatacactgatgatgtttacactattggtactagagtcagtaatggtgataaagctcttgatattgaaggaggtcgtaattcagacggtactaatgttttacaatggaccaatggtagcaaaggaaatcaaagttggattttcgaaaa

SEQ ID NO: 26576 - DNA, 423 bp, Neocallimastix californiae
  RICIN
ttggtattttattaagaatccagcttctggtaaatatcttcaagtttcaggtgccactaatggtggtgctggaggtaatgtagttatttcaacaggaactaaggataatggtcaaaaatggaaaattactaatgtaggtaatggtttagttactttcaccactgcacttggtgattatatgattgatgttgaagcaggttcaggtaagaatgatgccaatattcaattatataatgcttatggtggtgatgctcaacaatttatgattttaaagacaactgaaaaagatgtttatactattggtactaaagttagttactttgataaagctcttgatatagctcaagctaaaactgctgatggtacaaatgtcgttcaatggactaatgaaatgaaagctaatcaaagttggacctttgaaag

SEQ ID NO: 26577 - DNA, 405 bp, Neocallimastix californiae
  RICIN
tggtaactattacattaagaatccaaattctggtaaatatcttagagtaggtaaagctggtaacagccaaaatgttgttattggttcctcagctcaaaaatggaagcttactaacaccgacgatggatatattactttagttagtgaactcggaaattacatgatcgatgtagcaaatggtagtggtgaaaataacgctaatgttcaaatctatgatgcttatggaggagatgctcaaaaattcgttcttttaaagacttctcaatccaacacttacgttattgctactaaagcaagtaatggatacagagttcttgatattgaaaagaatggtactgctgaaggtagtaatgttttacaatgggataaccaagaaaaggctaatcaattttgggttttcgaaaa

SEQ ID NO: 26578 - DNA, 414 bp, Neocallimastix californiae
  RICIN
ggatggttggtataccattaaaaacccaaattctaacaaatatcttcaagttagttatggtagaggtggtgatgccgttaatgttgttatcggttccaacccacaaaaatggaaacttgaaaatgttggtgatggttatgttactttacttactatgtatggtgactacatgttagatgtagctgctggtgatagtaaagatggtgctaacattcaaatttattctgcttatggtggtgatgctcaacaatttgctattattccaacttctaacggtaatacttatgttattggtagtaaggttagtaatggtgaaaaagttcttgatattgaaaaagctagtacttctgaaggtagtaatgttttacaatgggttaatggtgaaaaagctaatcaaacttggatttttgaatc

SEQ ID NO: 26579 - DNA, 408 bp, Neocallimastix californiae
  RICIN
atggtattatattaaaaatccagcttctggtaaatatcttgctgttagaaatggtattggtgctgatgctcaaaatgttgaaattagttccacaaaacaaaaatggaagatttcaaataatgatgatggtactgttttaattattagtgaacttggagattatgctttagatgttagtgctggtagtagtaataatggagctaatattcaaatttattccgcctatggtggtgaagctcaaagatttattattagagaaacttatacctcaggaaattatgttattactactaaagttactaatggtagtagagctcttgatgttgaaggtaataaaactgcagaaggtacaaatatatgtcaatgggatgatggtgaaaaatctaatcaaatttggactcttgaagc

SEQ ID NO: 26580 - DNA, 414 bp, Neocallimastix californiae
  RICIN
aggtacttacaagattgttaatcgtaaaagtggaaaagtattagctgttgctaatgattctaaggcaaatgctgctaatgttcatcaatggacttacattgatggtaatgctagtcatcattggaagatttctgaagatggaggttacagaattctcaatgttaatgccaataaagtacttgatatgaatgcagaatctaccgctgatggaggtaatgctattatatggccagatactggaggtatgaatcaacgttgggttattgaaagtgctggaggtaattatgtttatattataaactctcacagtggaaaagctcttgatgttgataagagttcaaatgatgatggaggtaatattattcaatggagtcttagtaataatagttcaaaccaacaatggcaattaattcc

SEQ ID NO: 26581 - DNA, 399 bp, Neocallimastix californiae
  RICIN
gtacaccattaagaatactggctctggaaagtatcttcatgttgaaagtgctggtaacagtgaaaatgttgtcattagttcaaatgcttcaaagtggaagcttactaatactaatgatggttacattaccttaactagtagtgttggaaactatatgttagatgttgctggtggtgaagataaaaatggagttaatcttcaaatttacagtgcttatagtggagatgctcaaaaattcgtcatattaaagacttctaataataaggtatacactattggatccaaggttagtaatggcggtaaagttattgatgttgaaaaaagaggtacgactgatggaagtaatgttattcaatacgctcttaatggtgcttctaatcaaacttggacatttgaatc

SEQ ID NO: 26582 - DNA, 402 bp, Neocallimastix californiae
  RICIN
ttacattatgaatactggttctcaaagatatttaactgttaaggatgctaaagctgccaattcacaaaatattgaagtgaattccaaaaaacaaaaatggaaggttatgaatactagtgaaggtacagttaccatggaaagtgaacttggtaattatatgattgatgttaatggtggtagtgaagccaatggtgctaatattcaaatttatgaatcttatggaggagatgcccaacaattctatattagagaaacttatcaaaagaatgtttattctattggtactaaacttactggtggatacaaagttcttgatgtagaaaaggaaggtaagactgatggtagtaatgtatgtcaatgggaagatggaggtagatccaatcaaacctggttatttgaatt

SEQ ID NO: 26583 - DNA, 411 bp, Neocallimastix californiae
  RICIN
tggtaaatacaaacttattaatcgtaacagtggaaaagcattaggtgttgatggtgattctacttcaaatgctgctaatgttcaccaatggactgataatggtaaaactagtcaacaatggattattactgatgaaggttatggttataagatcatgaatgttaatgctaataaggcacttgatgttaatgaaaattctacaaagaatggtggtaatgttattatttggtctgataatggaaatcttaatcaacgttggtatattgaagaaattggtgatggatatattactttacaaaatattaatagtggattattacttgatgtagaaaagtcatctacctctgatggtggtaatgtattacaatgggaaaataatggtaatagtaatcaacaatggaaattaatacg

SEQ ID NO: 26584 - DNA, 420 bp, Anaeromyces robustus; identical to SEQ ID NO: 26575
  RICIN

SEQ ID NO: 26585 - DNA, 411 bp, Anaeromyces robustus; identical to SEQ ID NO: 26574
  RICIN

SEQ ID NO: 26586 - DNA, 414 bp, Anaeromyces robustus; identical to SEQ ID NO: 26578
  RICIN

SEQ ID NO: 26587 - DNA, 405 bp, Anaeromyces robustus; identical to SEQ ID NO: 26577
  RICIN

SEQ ID NO: 26588 - DNA, 423 bp, Anaeromyces robustus; identical to SEQ ID NO: 26576
  RICIN

SEQ ID NO: 26589 - DNA, 408 bp, Anaeromyces robustus; identical to SEQ ID NO: 26579
  RICIN

SEQ ID NO: 26590 - DNA, 414 bp, Anaeromyces robustus; identical to SEQ ID NO: 26580
  RICIN

SEQ ID NO: 26591 - DNA, 411 bp, Anaeromyces robustus; identical to SEQ ID NO: 26583
  RICIN

SEQ ID NO: 26592 - DNA, 408 bp, Anaeromyces robustus
  RICIN
gtattatattaaaaatactggttccaacaaatatcttaccgttaaaaatggtaaaggtgctgccgctcaaaatgttgaaattaattccactaaacaaaaatggaaagttactaatatggatgataatactattacattacttagtgaacttggagattatatgttagatgttagtagtggtagtagtgaaaatggagctaatattcaaatttatgatgcttatgctggagatgctcaaaaatttgttcttagagaaacttctaaagaaggagtttatgttattagtaccaaggttagtaatggttataaagttcttgatgtagaaagagaaggtaaaagtgatggtagtaatgtttgtcaatgggataatggaggtgaaaaagctcatcaaacttgggtatttgaatc

SEQ ID NO: 26593 - DNA, 408 bp, Anaeromyces robustus
  RICIN
aggtacttacagaattattaaccgtaacagtggaaaagctttatcagttgctaatgattccaagaataatgctgctaatgttcatcaatggacctacagtaataaagctagtcaacaatggaagattactgaagatggaggttacagaattcttaatgttaatgccaataaagtacttgatatggataatgaatcattaaaagatggaggtaatgcccttatatggccagatactggagcattaaatcaacgttggcttattgaagatgctggtaatggatatgttaatattataaactataatagtgaaaaagctcttgatgttgaaaagaattcaaatgctgatggaggtaatgtcattcaatggacacttactaatagtgcaaaccaacaatggcaattaattcc

SEQ ID NO: 26594 - DNA, 396 bp, Anaeromyces robustus
  RICIN
aaaagattataatatagtatcagtacttagtggaaaatatgtaacagctgccagtaatggtaatgtacaacaatatgaaaaacttaataatgacaaatctcaaatatggcgtttagaaagtgcaggtaatggaagatttgctatacttcaaggtaatatggctatgactgtagaaaatggtaataacaataatggaaataatatttatatgtcagaatacagaaaaacaactgctcaacacttttcaattaatagagctgataattcttactatattgttgctcaatgtacagttaatgctgcacttgatgtatttgatcaaagtaaagaaaatggtgctaatattgatcaatgggactactggggtggagataatcaaaaattctatattttccc

SEQ ID NO: 26595 - DNA, 411 bp, Anaeromyces robustus
  RICIN
tggtatttataaacttcttaatcgtaatagtggaaaagctttaggtattgaaagtgattctactacagatggtgctaatgttcatcaatggactgataatagtagaactagtcaacaatggatatttatagatgaaggtaatggttataagatcatgaatgtaaatgctaaaaaagctcttgatatttatggaagttctgtagaaaataatggtaatgctattattatgaccgataatggaaattcaagtcaacgttggactgttaaagatcttggtgatggatattacattattcaaaacgttaatagtggattattacttgatgttgaaagaaaatctacagctgatggtggtaatgtattacaatggccaaataatggtaatagtaatcaacaatggaaattagttcg

SEQ ID NO: 26596 - DNA, 411 bp, Anaeromyces robustus
  RICIN
aaatacttttaaaattattaatcgtttaagtggtaaagcattatcagttaatggtgattctacagctaatgaagccaatgttattcaatggaccgataatggtaaaacaagtcaacaatggattattacccaagaatcaaatggatataagattatcaatgttaatgctaataaagctcttgatgtttataaaaattcaagagataatggtggaaatgttattatttggtatgataatggtgcatctaatcaacgttggaatattcaagaagttggtaatggatattatactttacaaaatcttaatagtggaaaattacttgatgttgaaaaagaatcaagaaatgatggaggaaatgttttacaatgggttaataatggtaatacaaatcaacaatggcaaattgttag

SEQ ID NO: 26597 - DNA, 402 bp, Anaeromyces robustus
  RICIN
gtacaccattaaaaatactggatcaggtaaatatcttcaagttagttatggtagagctggtgatggtgttaatgtagttattggttctaacgctcaaaaatggaaacttgaaaatgttagtgatggttatgttactttacttactatgtatggggattatatgttagatgttgcagcaggtgaagataaggatggtgctaatcttcaaatttattcttcttatggtggtgataatcaacaattttcaattttaaagatttctgatgatgtttatgctattgctactaaagttagtgatagtactaaagttcttgatgttgaaaaagctagtactactgatggaagtaatgttttacaatggaaaaataaagaaacaagtaatcaaacttggatttttgaatc

SEQ ID NO: 26598 - DNA, 414 bp, Piromyces finnis
  RICIN
tgatggttggtatactattaagaacactggatctggaaaatatcttcaagttagtaacggaagagctggtgacagtgctaatgttgtcattggttcaagtgctcaaaaatggaaacttactaatgttgataatggatatgtcaccttagttagtatgtacggaaattacatgttagatgttgccaatggtgattccaagaatggagctaaccttcaaatctacacttctcatggtggtgatgctcaacaatttatcttcttaaatacctcaaagaataatgtttacgttattggtactaaggccagtagtggtactaaggttcttgatattgaaagtgaaggtactgccgatggaagtaacattttacaatgggaaaatggtgaaaagagcaaccaaacttgggttattgaatc

SEQ ID NO: 26599 - DNA, 405 bp, Piromyces finnis
  RICIN
gtattacattaagaatactggttctgaaaaatatcttacagtaaaaaatggtaaggcagccaattctcagaatgttgaagtcaattctgtaaagcaaaagtggttaattactaatatggatgatgatactattaccatacttagtgaacttggtaattacatgctagatgttaatggtggtagtgataaaaatggtgctaatattcatatatatgatgcttattctggagaccctcaaagattcattattagtgaaacttatcaaagtaatgtttataccattggtactaaagttacttatggtgaaaaagttcttgatgttgaaaatgaaggcaaatctgatggtagtaatgtttgtcaatgggaaaatggtgaaagatcaaatcaaacctgggtatttgaatt

SEQ ID NO: 26600 - DNA, 405 bp, Piromyces finnis
  RICIN
aaaagattatatgattgtatcccaacttagtggtaaatatatcactgttggtaataatggaaatattcatcaatgggaaaaacttagtgatacaagttctcaagtatggcgttttgaaagcgctggtagtggtaaatttgctattttatcaggaaaaatggctcttaccgtagaaaacggtaacaataaaaacggtaataaaatgattttatctcaatatcaaaataatgcagctcaacgttttattttccataaaaccgatgatgtatatgataattattatatcactgctgaatgttctggtaatgctgctttagatgtttatgatcaaagttatgataatggtgctaatattgatcaatgggattattggggtggagataatcaaaaattttatgttattcc

SEQ ID NO: 26601 - DNA, 405 bp, Piromyces finnis
  RICIN
ttattatatcaagagtgtatcttcaaacaagtatcttgttgtcaaggatggtataggagctaatgctcaaaatgttgaaattggttcaaccaaacaaaaatggaagatcagtaataatagtgatggtacagtttatatcattagtgaattaggtgattatgctttagatgttgacagaggtctcggtgataatggtgctaatatccaaatttatccacttcacggaggcgaagctcaaaagtttattattagggaaacttatccatccggtgtttatgttattgatactcaagcaagtaatggaagtaaagcacttgatattgaaggtgaaagaactgctgatggtacgaatgtatgtcaatggactgatggaggtaaggataatcaatcctggacttttatatc

SEQ ID NO: 26602 - DNA, 420 bp, Piromyces finnis
  RICIN
ttggtatttcattaaaaatccttcaactggaaagtatcttcaagttagagatgaagaaggaaaaaatgttgccaatattgaaattggctcaggacgtaaatctgatggacaaaaatggaaattaactaatgttggtgatggctatgtcacattaacctctgctcttggtgaatataatattgatattgctaatggtgaagataaaaatggagctaatgttcaaatctatgaagcatatggtggtgatgctcaacaatttgttattatgaccacttctacagataacgcctattccattggaactaaggcaagttcaggtgataaggttattgatattgaaggtggatatagtactgatggaaccaatgtttgtcaatggaagagtaacagtggaccaaatcaagtctggatttttgaaag

SEQ ID NO: 26603 - DNA, 411 bp, Piromyces finnis
  RICIN
tggtacctacaaaatcattaaccgtcaaagtggaaaagtattaagtgttaataacgattctactgctaacgctgctaatgtcattcaatggtccgaaagcaacaagagtagtcaacaatgggttattagtgaagaaggtgattactttagtttaataaatgttaatgccaagaaagctcttgatgtaaatgaaaattcaactgaaaatggtggtaatgtcattatctggccagatactggagcccttaaccaacgttggagtattcaaagtactggtgatggttattacaccattacaaatgccaacagtggaaagaatctcgatgttgaaaagggatctatgtctgatggtggtaatgttttacaatggggtaataatggtggtgctaatcaacaatggaagttagttcg

SEQ ID NO: 26604 - DNA, 411 bp, Piromyces finnis; identical to SEQ ID NO: 26603
  RICIN

SEQ ID NO: 26605 - DNA, 411 bp, Piromyces finnis
  RICIN
tggtacttataaaattattaaccgtcgtagtggaaaagctttaggagttattaacgattcaactgaagatagtgccaatgttcatcaatggactgataatggacataaaagtcaacaatgggttatttcaaatgaattcaatggaataaaaattgtcaacgttaatgcaaataaatgtttagatgttagcggaagatcaaaggataatggaggtaatattgttatttaccatgataatggatatatgaatcaacgttggactttccaagatgcaggtaatggttatattactattagaagttcacatagtggaaaacttattgatgttgataatagagcaacaacggatggtgcaaatgtacttcaatgggaaccaaatggtctagacaatcaacaatggaaacttgttaa

SEQ ID NO: 26606 - DNA, 420 bp, Piromyces finnis
  RICIN
ttggtattacattaagaacccagcttcaggtaaatacctccaagttgctaataaccaagctaaggctacagccaatattgaaattggatcatctagtcaagatgatggacaaaagtggttacttactaatgttggtgaaggttatgttaccttaaagagtgctcttggcgatttcatgattgatgttagtagtggtgaagacaagaatggagccaatattcaaatctacactgcctatggtcacgatgctcaacaattcatgatcttaaaatctagtgttgaaggagcctacagtattacttcaagagttagtttccaagacaagggtattgatattgaaggagctcgtacagctgatggtaccaatgttttacaatggactagtgaaggtagagctaatcaattatgggcttttgaaaa

SEQ ID NO: 26607 - DNA, 420 bp, Piromyces finnis; identical to SEQ ID NO: 26606
  RICIN

SEQ ID NO: 26608 - DNA, 420 bp, Piromyces finnis; identical to SEQ ID NO: 26606
  RICIN

SEQ ID NO: 26609 - DNA, 411 bp, Piromyces finnis
  RICIN
gtattacattaagaatactggatctaacaaatatcttcaagtaaagggtaataatggtgtagccaatactaatgtcgaaatcggaacctttgcaggtgcttctggacaaaaatggaaggttacacaaacaagtgatggttacattactttaactagtgctcttggaaactttatgttagatgtagctaatgctaaagatactgatggtaataatattcttatttatattggttacagtggtgatgcccaaaagttctctcttaaaccagctggtaattcattcattattactacaaaggttagtaatggtaaaaaagctttagatgtttataactttggaacatctgatggtactaatgtttgtcaatggactgttggtggtcaatccaaccaaacctgggtatttgaacc

SEQ ID NO: 26610 - DNA, 420 bp, Piromyces finnis; identical to SEQ ID NO: 26606
  RICIN

SEQ ID NO: 26611 - DNA, 411 bp, Piromyces finnis; identical to SEQ ID NO: 26609
  RICIN

SEQ ID NO: 26612 - DNA, 405 bp, Piromyces finnis
  RICIN
gtattacattaaaaacactggttccaacaagtatctttcagttaagggtgctgttggtgctaacggtcaaaatgttcaaattagttccactaaacaaaagtggaagatttacaataacaatgatggtactgttctcttaattagtgaatttggtgattatgctttagatgtcagtaacggttctggtgaaaatggtgccaacattcaaatttactctattcatggtggtgatgctcaaaagtttatcattagagaaacctttgaatctaatgtttacgttattgatactcaagctagtaatggtcaaagagctcttgacgttgaaggtgctagaactgatgaaggtactaacatttgccaatggtctgatgaagaaaagagtaatcaaacttggactattgaatc

SEQ ID NO: 26613 - DNA, 408 bp, Neocallimastix californiae
  Ricin B-like lectins
agatggttggtacactattaagaataccggttctggtaaatatctttatgttgacaaagctggtgacgttgaaaatgttgtcattggttcaactgctcgcaaatggaagcttactaatgttagtgatggttacgttacattaacaagtgaacttggtaactatatgttagatgttgctaatggtgaagatgttaacagtgctaaccttcaaatctacagtgcatatggtggtaatgctcaacaattcgttatcttaaaaacttctaattctaatgtttacactattggtactaaggcaagtagtggacaaagagttcttgatgttgaaaagagaggtaccactgatggtagtaacgttattcaatacgctcttaatggtgcttccaaccaaacatggacttttgaatc

SEQ ID NO: 26614 - DNA, 417 bp, Neocallimastix californiae
  Ricin B-like lectins
tgatggttggtactatattaagaacactggatctgacaagtaccttcaagctaatggttctagtgctggtgccaatgttgaaattggttcattcactggttattccgatcaaaagtggaaggttactactaatggtgaaggttacattactttacttaatggtaatggaaactttaacttagatgttgatagtgctaagaatgaaaatggtgccaacattttaatttatgatgcttacggtggtgttgcccaacaatttgctcttactgctggaagtggtaattcattcattattactacaagagttagtaatggtggaaaggctatcgatgtttacgaaaacagaactaatgatggtgctaatgtctgccaatggtctgttaatggaaactcaaaccaaacttgggtcttcgaaag

SEQ ID NO: 26615 - DNA, 417 bp, Neocallimastix californiae; identical to SEQ ID NO: 26614
  Ricin B-like lectins

SEQ ID NO: 26616 - DNA, 414 bp, Neocallimastix californiae
  Ricin B-like lectins
agatggtaattattacattaagagtaatttcgccaataaatatcttgttgttagggatggtagaggtgccaatgctcaaaatgttgaaattggttccactaagcaaaaatggaaaattacaaataatgatgatggtacagtttatattgtaagtgaatttggtaatttctctttagatgttgatagaggttccggtgacaatggtgccaacattcaaatttattctcatcacggaggagaagctcaaaaattcattattagagaaactaatcaatctggcgtttatgttattgatactcaagctagtaatggatatagagctcttgatgttgaaggtgagagaacttctgaaggtactaatgtttgtcaatgggatgattccggtaagagtaatcaaacttggacttttgaatc

SEQ ID NO: 26617 - DNA, 429 bp, Neocallimastix californiae
  Ricin B-like lectins
tgaggatggttggtatttcattaagaatccaaaatctggattatatcttcaagttagtaatgaagaagctagagctgtagctaatattgaaattggttccggtagcaagtctgatggacaaaaatggaaggtaactaatgtaggtgatggttatgttaccttaacttccgctcttggtgattttaatattgatattgccaatggtgaagacaagaatggagctaatgttcaaatttatgatgcctatggtggtgatgctcaacaatttgttattatgactacctctactagtaacacatacactattggtactaaaattagtaatggtggaaaagctcttgatatagaaaatgacagtacttacgaaggtactaatgtttgccaatggactaacggtagtaagggaaatcaattatgggtctttgaaaa

SEQ ID NO: 26618 - DNA, 417 bp, Neocallimastix californiae
  Ricin B-like lectins
tgatggttggtacaagattaagaaccccgtttccggtttataccttcaagttgccaatgctgaaggggccgacgctcaaaatgttgaaattggtactgactctgaacagatgtggaagcttaccaatcttggagataactacgttaccttaaccagtagtctcggtaatttcaacttagatatctgtatggctgaagatgaaaacggtacgaacgctcaaatttacaccgttcacaatgaagatccacaaaaattcgttattatggaaacgaaagacaaggatgtttacgtcatcggtacgaaaggtagtaatggttataaggttcttgatgttgaaagttatggtactactccaggaagtaacgtttaccaatgggaaaatgaaggtaaggacaaccaagtttggactttcgaact

SEQ ID NO: 26619 - DNA, 411 bp, Neocallimastix californiae
  Ricin B-like lectins
aaatgatggttggtattacattacaaatactaattcaaataagtatcttagtgttagaaatggtgttggagctaatagtcaaaatgtcgaacttggttccactcaacaaaaatggaaacttaccaacaacagtgatggatcagttactttagttagtgaagttggagactttgctttagatgttagtggtggttcttctgataatggtgctaatgttcaaatctactctaactatggtggagatgcccaaaagttctatatcagagaagtttcatccaacgtctatactattaccactaaggtaagtaatggtgaaaaggctcttgatgccgaaggtgccagaacttctgacggtactaacattttacaatggacagatgaaggaaagagtaaccaaacttggacttttaa

SEQ ID NO: 26620 - DNA, 411 bp, Neocallimastix californiae; identical to SEQ ID NO: 26619
  Ricin B-like lectins

SEQ ID NO: 26621 - DNA, 423 bp, Neocallimastix californiae
  Ricin B-like lectins
agatggttggtattacattaagaatccaagcactggaaagtacattcaagttgaagatggtgttggtcgtaatagtgctaatgttgttattggttctgaacgtaaggatgatgcccaaaagtggaaggttactaacactaatggttatgttacctttacatctgctcttggtaattatatgattgatattgccaatggagaagatagaaacggagccaatgttcaaatttatgatgcctacggtggtgatgctcaacaattcattatctacaagactggtagagaaaatgtttacactattggtactaaggcttctgcaggagataaggctattgatattgaaggagcacgtaatggtgaaaacgttaatctcttacaatggactaatgaatataaggataaccaaacttggtcctttgaaaa

SEQ ID NO: 26622 - DNA, 417 bp, Neocallimastix californiae
  Ricin B-like lectins
taatgatggatggtattacattaaaaatactggatctggtaaatacctcaatgttaaggatggtaaagctgcttctactcaaaatgttgtaattggttcttctaaacaaaaatggaagcttaccaacaacagtgacaataccgttactttacttagtgaagttggagatttcatgttagatgttaatggtggcagtagtgataatggtgccaatattcaaatttacaatgcttatggtggagatgctcaaaaattcgtcattagagaaacttctcaagctaatgtatatgttgtcagtactaaggtttcaagtggttacaaggttcttgatgttgaaaatgaaggtaaatacgatggtagtaacatttgtcaatgggaaaatggtgaaagaagtaatcaaacttggacttttgaatc

SEQ ID NO: 26623 - DNA, 417 bp, Neocallimastix californiae
  Ricin B-like lectins
taatgatggatggtattacataaaaaacccaagttcaggaaaatatcttgttgttaaagataaaaagggtgctgcttctcaaaatgttgaaattagttcttctaagcaaaaatggaagcttaccaacaataatgataataccgttaccttacttagtgaagttggagatttcatgttagatgttaatggaggtagtgacaagaataatgctaatattcaaatttatcatgcttatggtggagatgctcaaaaattcatcattaaagaaacttcacaaagtaatgtatatgttataactactaaagtttctaatggtagcaaagctcttgatattgaaaaggaaggtaaaaacgatggtagtaacgtcttacaatgggataatggtacaaaaagtaatcaaacttggatttttgaatc

SEQ ID NO: 26624 - DNA, 417 bp, Neocallimastix californiae
  Ricin B-like lectins
taatgatggctggtattatattaagaacactggttctggtaaataccttactgttaagggtggtgtagctgttgcaggtcaaaatgtagaaattggatctactaaacaaaaatggaagcttaccaacaatgatgacaatactgttactttacttagtgaagttggagatttcatgttagatattgacagaggtcttgaagaaaatggtgctaatattcaaatctaccatgcttacggtggagatgcccaaagatttatcattaaagaaactggtaagtctaaggtttatgtcatcagttctaagattactaatggttacaaggttcttgatgttgaaaatcaagcaactgctgatggtagtaatgtttgtcaatgggaaaatggtgaaagaagtaatcaaacttggacttttgaatc

SEQ ID NO: 26625 - DNA, 414 bp, Neocallimastix californiae
  Ricin B-like lectins
gaatggttggtataccattaaaaatccagaatctggtaaatatcttcaagtaagtaatggaagagcttctgatagtgctaatgtagttattggtaccaatgctcaaaagtggaaacttgaaaatgttggaaacggttacgtaactttagttagtatgtatggtaactacatgttagatattgctaatggagaagataaagatggttctaaccttcaaatatactctgcttatggtggtgatgctcaacaatttataattttgaagactcctcagaataatgtatatgcaattggtactaaggctagtgaaggtactaaagtacttgatattgaaggtggaagaacatccgaaggttctaatgttttacaatggactaatggcggaaagagtaatcaaacttggacttttgaatc

SEQ ID NO: 26626 - DNA, 414 bp, Neocallimastix californiae
  Ricin B-like lectins
tggttggtactatattaagaacactggctctaacaagtatctccaaactgttggttccactgctaattcaaatgtagaaattagttcattcactggttctgctgcacaaaaatggaaggtaactaagaatagtgaaggatacattacattacttaatggtgttggtgatttcaatttagatgtagccaacggtaagaatgaaaatggtgtaaatattttaatttatatcgcttatggtggtgaagctcaacaatttgctctctctgctggaagtaacaattctttcattatcacaactagagttagtaatggtgataaggccttagatgtatatgaacacagaaccgaagatggtgcaaatgtttgccaatggacaacttcaggtaaaccaaaccaaacttgggtattcgaaaa

SEQ ID NO: 26627 - DNA, 417 bp, Neocallimastix californiae
  Ricin B-like lectins
caaagatggttggtactacattaagaatactggttctaataaatatcttactgttaaggatggtagaggtgctagttctcaaaacgttgaagtcaattctagaaaacaaaaatggctacttactaatgttggtgatgatgaagttactttaactactgaacttggtaattatatgttagatgttaattctggtagtgaaaataatggagcaaacattcaaatctataatagtcatggaggagattctcaaagattcattattgaagaaacttatcaaagtgatgtttatgtcattggtacaaaggtaactaatggttataaggttattgatgttgaaagagaaggtaaggacgatggtagtaatgtttgtcaatgggataatggtgaaaaaccaaaccaaacttgggtattcgaatt

SEQ ID NO: 26628 - DNA, 411 bp, Neocallimastix californiae; identical to SEQ ID NO: 26561
  Ricin B-like lectins

SEQ ID NO: 26629 - DNA, 417 bp, Neocallimastix californiae
  Ricin B-like lectins
tactgacggttggtattatattaagaacagtagttctggtaaatatctttctgttagaaatggtgttggtgctaatgcccaaaatgttgaaattggttcttcaaaacaaaaatggaaggttacaaaaaataatgatggttccgttgtaataatttctgaatttggtaacttcgctttagatattgcaaatggttctggagataatggagctaatgttcaaatttacactactcatggtggtgatgctcagaagtttattattagagaaacttctaactctggtatattcgttattgatactattgctagtggtggttctaaagctttagatattgaaggtggtcgtagtgctgatggtactaacatttgtcaatgggatgattctgcaaagagtaatcaaacttggacttttgaagc

SEQ ID NO: 26630 - DNA, 420 bp, Neocallimastix californiae
  Ricin B-like lectins
tattccagaaggtacatataaattaattaaccgtcgtagtaacaaggctttagctgttcaaaatgactccaaggataacgctgctaacgttgttcaatggactgaaagtaataaaactagtcaacaatggaagattactgaagatggaggttacagaatcttaaatgtcaatgccgataaagcccttgatgttgaaagagattcaactcaaaatggtggtaatattatcatttggcctgataccggtaacctcaatcaacgttggactattgaagatgctggaaatggttatgttgaaatcgttaatcttagtagtggtaaagctcttgacgttgaaaatgaatccactgctgatggtgccaatgtttgtcaatgggatgctcatggtagtcaaaaccaacaatggaaattagttccagt

SEQ ID NO: 26631 - DNA, 420 bp, Neocallimastix californiae
  Ricin B-like lectins
tcaagatggttggtatactattaaaaatactggttctggaagatatcttcaagttagtcaaggtagagctagtgatagttccaatattgttattggttctaatgctcaaaaatggaaacttgaaaatgttgatgaggaatatattactttattaactatgtatggaaactatatgattgatgtagctaatggtgaagataagaatggatcgaatattcaaatttatagtgcttatggtggtgatgctcaacaatttactcttataaagacatcaaaagaaaatgtttatgtaattggtactaaagtatctcaaggtgctagagttttcgatgttgaaagtgccagtactgctgaaggaagtaatgttttacaatggagtaatggtggtgaaagatctaatcaaacttggcttttcgaaaa

SEQ ID NO: 26632 - DNA, 420 bp, Neocallimastix californiae
  Ricin B-like lectins
tattccagatggtacctaccgaattattaatcgtaacagtggaaaagctttatctgttgttaatgattccaagaataatgcagctagtgtggttcagtatacttacacgggtaagagtagtcaacaatggaagattgttgaagatggaggttacagtttcaccaatgttaattctaataaagtacttgatatgaatggagcctctcttgaagatggaggtaatgctattatttggccagatattgctggtccaaatcaacgttggtctattgaaaatgctggagatggttatgtctatattattaactttaatagtaataaagtccttgatgttgccaatgtttcaaaggaagaaggaggaaatgttcatcaatggaccatcacaaatggtgccaatcaacaatggcaattaattccaat

SEQ ID NO: 26633 - DNA, 420 bp, Neocallimastix californiae
  Ricin B-like lectins
cagtggtgacagatacaagatcattaatcgttacactaacagagttttagctgttgaaaacgattccaccgctaataatgccaatgttctccaatggggtgacaatggaagttccggtcaacaatgggttgttgctaaggaaggtgatcaatacagaattactagctatactaccaacaaggccttagatgtcagtggaagatcaactgccgatggtggtaatgttattatttatgatgataaggctcaaggtaatcaacgttggaagtttattgatgccggtgatggttatgttatcattgaaaatgtaaatagtggaaaggttcttgatgttgataacgcctcaaaggaatatggtgctaatattatgcaatggagaaagaatggtagtactaaccaacaatggaaattagttccatt

SEQ ID NO: 26634 - DNA, 429 bp, Neocallimastix californiae
  Ricin B-like lectins
tgaagatggttggtacttcatcaagaatccaagatctggtttatatcttcaagttagtaatgattatgctagagcttctgccaatattgaaattggtactggaacaaaatctgatggtcaaaaatggaaagttacaaacgttggtgatggatacattactttaactactgctcttggtgacttcaatattgatattgccaatggtgatgataaaaacggagccaatgttcaaatctatgatgcctacggtggaaatgctcaacaatttgttgttatgactacttctgacagtaatacctatactataggttctaaggtcagtagtggtggtaaagctcttgatattgagaatgaaagtacctcagatggtgccaacgtttgtcaatggacaaacagtagtaagggtaaccaattatgggtctttgaaaa

SEQ ID NO: 26635 - DNA, 420 bp, Neocallimastix californiae
  Ricin B-like lectins
taaggatggttggtatactatcaagaacacaggttccggtaaatatcttaatgtagattatggtagagctagtgctggagctaatgttgttattggttctgatgctcaaaagtggaaggttgaaaacaacagtgaaggttatgttactttagtatctatgtatggtaattacatgttagatattgccatgggtgaagataagaatggagcaaacattcaaatttacgatgcttatggtggagacgcccaacaattctctcttattgaaacttctaagaagggagtttacgttattgctacaaaagttagtcaaaatgataaatgtcttgatgtcgaaagtgctagtaccgcagaaggtagtaacgttttacaatggacaaacggtggtgaaagaagtaatcaaacttggtctttcgaatc

SEQ ID NO: 26636 - DNA, 417 bp, Neocallimastix californiae
  Ricin B-like lectins
taaagatggatggtatacaattaaaaatactggatctggtaaatatcttcaagttcaaaatggtagagcttcagatagtgcaaatgtagttataggttccaatgctcaaaaatggaaaattcaaaatattggagatggctatgttactattctttccatgtatggtgattatatgttagatgttgccaatggtgaagatgtagatggtgctaatgttcaaatttattcttcctatggtggtgatccacaacaatttattattgctgaaacttcaagaagtaatgtatatgttattggtagtaaagttagtgaaggtaataaggttattgatattgaacatgaaagtactgaagaaggtagtaatgttcatcaatggactaacagtgaaaagagtaatcaaacatgggttatagaatc

SEQ ID NO: 26637 - DNA, 420 bp, Neocallimastix californiae
  Ricin B-like lectins
aactactggtggtaaatacaagattgttaaccgtaacagtggaaaagttttagctgttgttagtgattctacttcaaatggagctgatgtcattcaatggtctgataatggaaagactagtcaacaatgggtcatcacagatgaaggcaatggttataagattatgaatgttaatgctaataaggctcttgatgtcagtgaaaattcagtgaaggatggtggtgatgttattatctggagtgataatggccataataaccaacgttggaatatccaagatgttggtaatggttatgttactattaaaaacgtcaacagtggtaagaaccttgatgttgagaaggaatctacctctgatggagctgatgttatacaatggggtaataatggtaacagtaaccaacaatggaaattagttgc

SEQ ID NO: 26638 - DNA, 414 bp, Neocallimastix californiae
  Ricin B-like lectins
tggtggtaaatacaagattattaaccgtaacagtggtaaagctttaggtattgatggtgattctacttcaaatggtgccaatgttattcaatggtctgataatggaaagactagtcaacaatgggtcatcacagatgaaggcaatggttataagattatgaatgttaatgctaataaggctcttgatgtcaatgataattcaatgaaggatggtggtaatgttattatttggaatgataatggtaataataaccaacgttggaatattcaagatattggtggtggttatgttactattgaaaacgtcaacagtggtaagaaccttgatgttgaaaagggatccacctctgatggaggtaatgtattacaatggggtaacaatggcaacagtaaccaacaatggaaattagttgc

SEQ ID NO: 26639 - DNA, 414 bp, Neocallimastix californiae
  Ricin B-like lectins
agttgctggagaagagtatcgcattgcaattcaactcagtggaaaatatataacagctgccaataatggaaatgttcaccaatgggaaaatttaaatgataattctcaagtttggtattttgaagatgcaggtaatggaaaatttgctattctttcaggaaaaaatagaaaattagccatgacggttgaaaatggtgattctaaaaatggtaataatattcttcttactgaatataaaaatactgctgctcaacattttattctccatggagtagatgatgcgtactatattactgccgaatgttccggtaaagcctcactcgatgtttataatcagagttatgataatggtgctaatattgatcaatgggcttactggggaggtgaatgtcaaaagttctatataatacctgc

SEQ ID NO: 26640 - DNA, 429 bp, Neocallimastix californiae
  Ricin B-like lectins
aaaagatggatggtattttattaaaaattcaagttctggaaaataccttcaggtaagtaatgaaaattctagagctgcttcaaatattgaaattggttctagtcgtaaatctgatggtcaaaaatggaagctaactaatgttggtgatggttatgttactctaacttcagctctcggtaattttaatgttgatgttgctaatggagaagataaaaacggtgctaatattcaaatttatgatgcttatggtggtaatgctcaacaatttattattatgactacttcattctctaatgtttatactatcggaaccaaagttagtaatggtgaaaaggctcttgatgttgaaaatggaagtaaatctgatggtgccaacgtaattcaatggaaaaatgaaagtaaggataatcaaagttggatttttgaaaa

SEQ ID NO: 26641 - DNA, 414 bp, Neocallimastix californiae
  Ricin B-like lectins
aggtggaaaagattatatgattatgtcacatcttagtggaaaatatataacaatagctaatgatggaagtattcatcaatgggaaaaacttagcgacactaaatctcaagtatggcgctttgaaagtgccggtaatggaagattcgctattctttcaggaaacaacgccttaactgtagaaaatggtaataataaagatggtaataaaattattttatcacaatatcgtaaaacatccgctcaacatttcattcttcacaaaactgatggtaattatgatacctactatattactgctgaatgttctggtaacgctgctttagatgtttatgatcaaagctctgataatggagcaaaaattgatcagtggaattattggggtggagataatcaaagattttatattattccaat

SEQ ID NO: 26642 - DNA, 429 bp, Neocallimastix californiae
  Ricin B-like lectins
agatggttggtattttattaaaaacccagaatcaggaaagtatcttcaagtatcagctgcaaaagatgcaagctccgctggtaatgttgtaatttcaactggaaccaaagacaatggtcaaaagtggaaacttaccaatgttagcaatggtttagttactttaacatcatcacttggtaattataatattgatgttgctaatggaaaagattctaatggtaataatattatattatataattcttatggtggtgaaccgcaacaattcatgattttaaaaacttcccaaaaaaatgtttatactattggtacaaaagtaagtaacttcgataaagcttttgatattgaaaatggaagatcaactgatggcacaaatgttttacaatggactaatgaaatgaaacctaaccaactttggatgtttgaaaa

SEQ ID NO: 26643 - DNA, 420 bp, Neocallimastix californiae
  Ricin B-like lectins
tgatgaaggttggtacttcataaagaacccatctactggtaagtatcttactgcttctggtaactcagttccattcaatgtaattattagtaccggataccaagaagacaatcaaaagtggaaggttactaacgctggtaatggttacattactttaactagtggtcttggtgactatatgttagatgttgccaatggttctgctaataatgatgctaacattcaagtttatagtgcctatggaggagatgctcaacaattcaaacttgttgaatacggtagtggtgaatttgctattgttactaagtctagtaacgatggtaaggctgttgatattgccaacaacggttacactgatggtactaatgttttacaatggactaacagtggtaagagcaaccaaatttgggtattcgaaaa

SEQ ID NO: 26644 - DNA, 426 bp, Neocallimastix californiae
  Ricin B-like lectins
tgatggatggtattttataaaaaatccaagttctggtaaataccttcaagttgctaacgaaaatggtaaaaatgttgccaatattgaaatcggtacaggcagacaatctgatggtcaaaaatggaaacttactaatgttggtaatggttatgttactttaacttcagcccttggtgaattcaacattgatattgccaatggagaaaacaaagatggaactaatgtacaaatttatgaagcctatggtggtgaagctcaacaattcgttattttaactacatacactgatgatgtttacactattggtactagagtcagtaatggtgataaagctcttgatattgaaggaggtcgtaattcagacggtactaatgttttacaatggaccaatggtagcaaaggaaatcaaagttggattttcgaaaa

SEQ ID NO: 26645 - DNA, 429 bp, Neocallimastix californiae
  Ricin B-like lectins
agatggttggtattttattaagaatccagcttctggtaaatatcttcaagtttcaggtgccactaatggtggtgctggaggtaatgtagttatttcaacaggaactaaggataatggtcaaaaatggaaaattactaatgtaggtaatggtttagttactttcaccactgcacttggtgattatatgattgatgttgaagcaggttcaggtaagaatgatgccaatattcaattatataatgcttatggtggtgatgctcaacaatttatgattttaaagacaactgaaaaagatgtttatactattggtactaaagttagttactttgataaagctcttgatatagctcaagctaaaactgctgatggtacaaatgtcgttcaatggactaatgaaatgaaagctaatcaaagttggacctttgaaag

SEQ ID NO: 26646 - DNA, 408 bp, Neocallimastix californiae
  Ricin B-like lectins
taatggtaactattacattaagaatccaaattctggtaaatatcttagagtaggtaaagctggtaacagccaaaatgttgttattggttcctcagctcaaaaatggaagcttactaacaccgacgatggatatattactttagttagtgaactcggaaattacatgatcgatgtagcaaatggtagtggtgaaaataacgctaatgttcaaatctatgatgcttatggaggagatgctcaaaaattcgttcttttaaagacttctcaatccaacacttacgttattgctactaaagcaagtaatggatacagagttcttgatattgaaaagaatggtactgctgaaggtagtaatgttttacaatgggataaccaagaaaaggctaatcaattttgggttttcgaaaa

SEQ ID NO: 26647 - DNA, 420 bp, Neocallimastix californiae
  Ricin B-like lectins
tcttaaggatggttggtataccattaaaaacccaaattctaacaaatatcttcaagttagttatggtagaggtggtgatgccgttaatgttgttatcggttccaacccacaaaaatggaaacttgaaaatgttggtgatggttatgttactttacttactatgtatggtgactacatgttagatgtagctgctggtgatagtaaagatggtgctaacattcaaatttattctgcttatggtggtgatgctcaacaatttgctattattccaacttctaacggtaatacttatgttattggtagtaaggttagtaatggtgaaaaagttcttgatattgaaaaagctagtacttctgaaggtagtaatgttttacaatgggttaatggtgaaaaagctaatcaaacttggatttttgaatc

SEQ ID NO: 26648 - DNA, 417 bp, Neocallimastix californiae
  Ricin B-like lectins
ttctgatggatggtattatattaaaaatccagcttctggtaaatatcttgctgttagaaatggtattggtgctgatgctcaaaatgttgaaattagttccacaaaacaaaaatggaagatttcaaataatgatgatggtactgttttaattattagtgaacttggagattatgctttagatgttagtgctggtagtagtaataatggagctaatattcaaatttattccgcctatggtggtgaagctcaaagatttattattagagaaacttatacctcaggaaattatgttattactactaaagttactaatggtagtagagctcttgatgttgaaggtaataaaactgcagaaggtacaaatatatgtcaatgggatgatggtgaaaaatctaatcaaatttggactcttgaagc

SEQ ID NO: 26649 - DNA, 417 bp, Neocallimastix californiae
  Ricin B-like lectins
taaagatggttggtatactattaaaaacactggatccggtttatatcttggtgttaacaatggaagagctagtgacagtgccaatgttgttattgattctgatgctcaaaaatggaaacttgaaaatgttggtaatggttacatgactttaacctccatgtacggtgattacaaaattgatattgctggtgctgatgattctaatggttctaatgttcaaatttacactactcacggtgaagataatcaacaatttattgttttaaagacttcaaaggataatgtttatgctattggtactaagattactaatggtgaaagagttcttgatgttgaaagtgaaagtacttctgctggtagtaatgttcaccaatggttaaatagtgaaaagagtaatcaaacttggacatttgaagc

SEQ ID NO: 26650 - DNA, 423 bp, Neocallimastix californiae
  Ricin B-like lectins
tccagaaggtacttacaagattgttaatcgtaaaagtggaaaagtattagctgttgctaatgattctaaggcaaatgctgctaatgttcatcaatggacttacattgatggtaatgctagtcatcattggaagatttctgaagatggaggttacagaattctcaatgttaatgccaataaagtacttgatatgaatgcagaatctaccgctgatggaggtaatgctattatatggccagatactggaggtatgaatcaacgttgggttattgaaagtgctggaggtaattatgtttatattataaactctcacagtggaaaagctcttgatgttgataagagttcaaatgatgatggaggtaatattattcaatggagtcttagtaataatagttcaaaccaacaatggcaattaattccagt

SEQ ID NO: 26651 - DNA, 408 bp, Neocallimastix californiae
  Ricin B-like lectins
agatggttggtacaccattaagaatactggctctggaaagtatcttcatgttgaaagtgctggtaacagtgaaaatgttgtcattagttcaaatgcttcaaagtggaagcttactaatactaatgatggttacattaccttaactagtagtgttggaaactatatgttagatgttgctggtggtgaagataaaaatggagttaatcttcaaatttacagtgcttatagtggagatgctcaaaaattcgtcatattaaagacttctaataataaggtatacactattggatccaaggttagtaatggcggtaaagttattgatgttgaaaaaagaggtacgactgatggaagtaatgttattcaatacgctcttaatggtgcttctaatcaaacttggacatttgaatc

SEQ ID NO: 26652 - DNA, 420 bp, Neocallimastix californiae
  Ricin B-like lectins
tattagagatggttggtattacattatgaatactggttctcaaagatatttaactgttaaggatgctaaagctgccaattcacaaaatattgaagtgaattccaaaaaacaaaaatggaaggttatgaatactagtgaaggtacagttaccatggaaagtgaacttggtaattatatgattgatgttaatggtggtagtgaagccaatggtgctaatattcaaatttatgaatcttatggaggagatgcccaacaattctatattagagaaacttatcaaaagaatgtttattctattggtactaaacttactggtggatacaaagttcttgatgtagaaaaggaaggtaagactgatggtagtaatgtatgtcaatgggaagatggaggtagatccaatcaaacctggttatttgaatt

SEQ ID NO: 26653 - DNA, 417 bp, Neocallimastix californiae
  Ricin B-like lectins
ttctggtggtaaatacaaacttattaatcgtaacagtggaaaagcattaggtgttgatggtgattctacttcaaatgctgctaatgttcaccaatggactgataatggtaaaactagtcaacaatggattattactgatgaaggttatggttataagatcatgaatgttaatgctaataaggcacttgatgttaatgaaaattctacaaagaatggtggtaatgttattatttggtctgataatggaaatcttaatcaacgttggtatattgaagaaattggtgatggatatattactttacaaaatattaatagtggattattacttgatgtagaaaagtcatctacctctgatggtggtaatgtattacaatgggaaaataatggtaatagtaatcaacaatggaaattaatacg

SEQ ID NO: 26654 - DNA, 426 bp, Anaeromyces robustus; identical to SEQ ID NO: 26644
  Ricin B-like lectins

SEQ ID NO: 26655 - DNA, 420 bp, Anaeromyces robustus; identical to SEQ ID NO: 26643
  Ricin B-like lectins

SEQ ID NO: 26656 - DNA, 420 bp, Anaeromyces robustus; identical to SEQ ID NO: 26647
  Ricin B-like lectins

SEQ ID NO: 26657 - DNA, 408 bp, Anaeromyces robustus; identical to SEQ ID NO: 26646
  Ricin B-like lectins

SEQ ID NO: 26658 - DNA, 429 bp, Anaeromyces robustus; identical to SEQ ID NO: 26645
  Ricin B-like lectins

SEQ ID NO: 26659 - DNA, 417 bp, Anaeromyces robustus; identical to SEQ ID NO: 26649
  Ricin B-like lectins

SEQ ID NO: 26660 - DNA, 417 bp, Anaeromyces robustus; identical to SEQ ID NO: 26648
  Ricin B-like lectins

SEQ ID NO: 26661 - DNA, 423 bp, Anaeromyces robustus; identical to SEQ ID NO: 26650
  Ricin B-like lectins

SEQ ID NO: 26662 - DNA, 417 bp, Anaeromyces robustus; identical to SEQ ID NO: 26653
  Ricin B-like lectins

SEQ ID NO: 26663 - DNA, 420 bp, Anaeromyces robustus
  Ricin B-like lectins
taagaatggttggtattatattaaaaatactggttccaacaaatatcttaccgttaaaaatggtaaaggtgctgccgctcaaaatgttgaaattaattccactaaacaaaaatggaaagttactaatatggatgataatactattacattacttagtgaacttggagattatatgttagatgttagtagtggtagtagtgaaaatggagctaatattcaaatttatgatgcttatgctggagatgctcaaaaatttgttcttagagaaacttctaaagaaggagtttatgttattagtaccaaggttagtaatggttataaagttcttgatgtagaaagagaaggtaaaagtgatggtagtaatgtttgtcaatgggataatggaggtgaaaaagctcatcaaacttgggtatttgaatc

SEQ ID NO: 26664 - DNA, 417 bp, Anaeromyces robustus
  Ricin B-like lectins
tccagaaggtacttacagaattattaaccgtaacagtggaaaagctttatcagttgctaatgattccaagaataatgctgctaatgttcatcaatggacctacagtaataaagctagtcaacaatggaagattactgaagatggaggttacagaattcttaatgttaatgccaataaagtacttgatatggataatgaatcattaaaagatggaggtaatgcccttatatggccagatactggagcattaaatcaacgttggcttattgaagatgctggtaatggatatgttaatattataaactataatagtgaaaaagctcttgatgttgaaaagaattcaaatgctgatggaggtaatgtcattcaatggacacttactaatagtgcaaaccaacaatggcaattaattccaat

SEQ ID NO: 26665 - DNA, 423 bp, Anaeromyces robustus
  Ricin B-like lectins
tcttcaaaatggttggtacactattaaaaacgttggttctggaaaataccttcaagtcagttacggaagtgcttctgacagtgccaatgttgttattggttctaatgctcaaaaatggaaacttgaacatgttgatgatgattacttcactttactttccatgtatggtaattacatgattgatattgctatgggtgaagataaggatggttctaatgttcaaatatattctgcctatggtggtgaagctcaacaatttagtgttataaaaacatctagagaaaatgtttaccttattggtactaaggtttctggaggtaaaagagtttttgatgttgaaaaagcaagtaaagctgaaggtagtaatgttttacaatgggttaatggtggtgaaaaagataatcaaatttggattttcgaagc

SEQ ID NO: 26666 - DNA, 423 bp, Anaeromyces robustus
  Ricin B-like lectins
tattaaaaatggttggtacactattaaaaaccctatttctggaaaatatcttcaaattcgttatggaagtgatgcagatacttccaatgttgttattggtactaatcctcaaaaatggaaacttgaacatgttgatgatgattatttcacattagcttctatgtatggtgattatatgttagatgttaatagaggtgaaaataaagatggtgcaaatattcaagtttattctgcttatggtggtgatgctcaacaatttagtgttgtaaaaacatctaaagaaaatgtttatgcaattgctacaaaaatttctagaggtactaaagttcttgatattgaattagcaagtacagctgatggtagtaatgtctgtcaatggactaatggtggtgaaaagaatcatcaagtatggacttttgaatc

SEQ ID NO: 26667 - DNA, 399 bp, Anaeromyces robustus
  Ricin B-like lectins
cggaaaagattataatatagtatcagtacttagtggaaaatatgtaacagctgccagtaatggtaatgtacaacaatatgaaaaacttaataatgacaaatctcaaatatggcgtttagaaagtgcaggtaatggaagatttgctatacttcaaggtaatatggctatgactgtagaaaatggtaataacaataatggaaataatatttatatgtcagaatacagaaaaacaactgctcaacacttttcaattaatagagctgataattcttactatattgttgctcaatgtacagttaatgctgcacttgatgtatttgatcaaagtaaagaaaatggtgctaatattgatcaatgggactactggggtggagataatcaaaaattctatattttccc

SEQ ID NO: 26668 - DNA, 417 bp, Anaeromyces robustus
  Ricin B-like lectins
ctctggtggtatttataaacttcttaatcgtaatagtggaaaagctttaggtattgaaagtgattctactacagatggtgctaatgttcatcaatggactgataatagtagaactagtcaacaatggatatttatagatgaaggtaatggttataagatcatgaatgtaaatgctaaaaaagctcttgatatttatggaagttctgtagaaaataatggtaatgctattattatgaccgataatggaaattcaagtcaacgttggactgttaaagatcttggtgatggatattacattattcaaaacgttaatagtggattattacttgatgttgaaagaaaatctacagctgatggtggtaatgtattacaatggccaaataatggtaatagtaatcaacaatggaaattagttcg

SEQ ID NO: 26669 - DNA, 420 bp, Anaeromyces robustus
  Ricin B-like lectins
tactaatggaaatacttttaaaattattaatcgtttaagtggtaaagcattatcagttaatggtgattctacagctaatgaagccaatgttattcaatggaccgataatggtaaaacaagtcaacaatggattattacccaagaatcaaatggatataagattatcaatgttaatgctaataaagctcttgatgtttataaaaattcaagagataatggtggaaatgttattatttggtatgataatggtgcatctaatcaacgttggaatattcaagaagttggtaatggatattatactttacaaaatcttaatagtggaaaattacttgatgttgaaaaagaatcaagaaatgatggaggaaatgttttacaatgggttaataatggtaatacaaatcaacaatggcaaattgttag

SEQ ID NO: 26670 - DNA, 417 bp, Anaeromyces robustus
  Ricin B-like lectins
tcttaaaaatggttggtacaccattaaaaatactggatcaggtaaatatcttcaagttagttatggtagagctggtgatggtgttaatgtagttattggttctaacgctcaaaaatggaaacttgaaaatgttagtgatggttatgttactttacttactatgtatggggattatatgttagatgttgcagcaggtgaagataaggatggtgctaatcttcaaatttattcttcttatggtggtgataatcaacaattttcaattttaaagatttctgatgatgtttatgctattgctactaaagttagtgatagtactaaagttcttgatgttgaaaaagctagtactactgatggaagtaatgttttacaatggaaaaataaagaaacaagtaatcaaacttggatttttgaatc

SEQ ID NO: 26671 - DNA, 309 bp, Piromyces finnis
  Ricin B-like lectins
taagattaaatcatgtgatgattctaattattctaaatggatggtattaccttctcgtaaaggttatttctattcaatggcttatcctgattattgtttacaagttgatgatgaaaatagtggttcacttgctttaggtaaatgtgatgatcaagctaaattagaacatacagatgatgctttctttaaattaattggttctgatgataaatgtattggtatcttagatgaaaatgatatgtataacaatgaaatagaattaaacttaaatacttgtattgaaagtgataatgaaaaattttatgtttg

SEQ ID NO: 26672 - DNA, 163 bp, Piromyces finnis
  Ricin B-like lectins
ttatagaattcgtaatattaaaactaagcaatgtgttttagttaataatagtgatggtaatttaattgatttaggagagtgtactacttcgaatcatagtttatggcatattgcaaatgtcgatgaatataacaacaagaaaattacatctgttaaaagtgga

SEQ ID NO: 26673 - DNA, 414 bp, Piromyces finnis; identical to SEQ ID NO: 26598
  Ricin B-like lectins

SEQ ID NO: 26674 - DNA, 414 bp, Piromyces finnis
  Ricin B-like lectins
ggatggttggtattacattaagaatactggttctgaaaaatatcttacagtaaaaaatggtaaggcagccaattctcagaatgttgaagtcaattctgtaaagcaaaagtggttaattactaatatggatgatgatactattaccatacttagtgaacttggtaattacatgctagatgttaatggtggtagtgataaaaatggtgctaatattcatatatatgatgcttattctggagaccctcaaagattcattattagtgaaacttatcaaagtaatgtttataccattggtactaaagttacttatggtgaaaaagttcttgatgttgaaaatgaaggcaaatctgatggtagtaatgtttgtcaatgggaaaatggtgaaagatcaaatcaaacctgggtatttgaatt

SEQ ID NO: 26675 - DNA, 417 bp, Piromyces finnis
  Ricin B-like lectins
tcttaaaaatggttggtataccattaagaatacaggttctaaaaaataccttacatcatctagtaatattgccggtggaaatatagttattagttcaaaagcacaaaaatggaaacttgaaaatgttggagaaggttatgttaccttactttctatgtatggtgattttatgattgatgtagctatgggtgaagataaggatggttctaacattcaaatttacactgcttatggtcatgatgctcaacaatttactattataaaaacaacaaaggaaaacgtttatataattggtaccagagtctctgaaggtggtaaagtattagatgttgaaagagaaggcactgcagatggtagtaatgtcgttcaatggactggtggtggtgaaaagggtaatcaaacttggcttttcgagtc

SEQ ID NO: 26676 - DNA, 414 bp, Piromyces finnis
  Ricin B-like lectins
tataagtggaaaagattatatgattgtatcccaacttagtggtaaatatatcactgttggtaataatggaaatattcatcaatgggaaaaacttagtgatacaagttctcaagtatggcgttttgaaagcgctggtagtggtaaatttgctattttatcaggaaaaatggctcttaccgtagaaaacggtaacaataaaaacggtaataaaatgattttatctcaatatcaaaataatgcagctcaacgttttattttccataaaaccgatgatgtatatgataattattatatcactgctgaatgttctggtaatgctgctttagatgtttatgatcaaagttatgataatggtgctaatattgatcaatgggattattggggtggagataatcaaaaattttatgttattcc

SEQ ID NO: 26677 - DNA, 300 bp, Piromyces finnis
  Ricin B-like lectins
ttatagtttccgtattaagaatagaaaaactcaagaatgtcttattaccaatttacattcagatactagtgttcttttgatgggtgattgtaatcatagtatatggacttatgacaatgaaacattggttttaaatgctactggtaaatgcatgtatgctatgaattctcaagatccaagaatgtttgattgtagcaaacctgatgaaacaattaaccatcatattcactttaaaatagttgacaacaaatacatttgcctcaagaacagtgtagatccagaaatttgtttgaacggcaa

SEQ ID NO: 26678 - DNA, 210 bp, Piromyces finnis
  Ricin B-like lectins
taaatgtgttaataacaaaaagaataaatggtttattagacaaaatggtcaagtatattttattgtatcatcctatgatgctaaatgtttgaatcttaatggtgaaaatttatatatggattattgtgaagataataataaatatgaaaaattcatcataaagaatggtaagttctgctcacaacttgataattcaaaatgtttaggagg

SEQ ID NO: 26679 - DNA, 360 bp, Piromyces finnis
  Ricin B-like lectins
cactgaaacttattacttgtacaacgcagataccaacaaatgtgtacactcttctggtgttctcgattcatcaattacattagctgaatgtgattactctacatactctctctgggatattccatacacacataatggtaatttccacttgaagtttgatattagtcactgtatcatgctttctgataacagttctttagttttaggtaaatgtggtgaaactggtactgatttctatcgtgatggcaactttatcaaatcaccaattacaccagatcaatgtattgctttagctgattcttccagtttagtgatgactgaatgtaatgaattcgatacaactcaactcttctacttcaa

SEQ ID NO: 26680 - DNA, 360 bp, Piromyces finnis
  Ricin B-like lectins
atactggttctatcatgcctataccaacaagtgtttatatgctccacaaaaaccaaataagccaatcaccgttaaagcttgtgatgattctgattattccaagtggatggtattgaattcacgtaaaggatacttctactctatggcacatccagattattgtttacgtgttgctgatgttgatacaggttcactcgaattaggtaaatgtgatgaccaagcaaagatggtccatggtaatgatggattcttaggattgattgaatctagcgacaaatgcgtaggaattcttaatgctgaagatatgtataaagatgaaattaaaatgaacttgaacacttgtgctaaaaacgatgatga

SEQ ID NO: 26681 - DNA, 360 bp, Piromyces finnis; identical to SEQ ID NO: 26679
  Ricin B-like lectins

SEQ ID NO: 26682 - DNA, 210 bp, Piromyces finnis; identical to SEQ ID NO: 26678
  Ricin B-like lectins

SEQ ID NO: 26683 - DNA, 366 bp, Piromyces finnis
  Ricin B-like lectins
atactggttctatcatgcctataccaacaagtgtttatatgctccacaaaaaccaaataagccaatcaccgttaaagcttgtgatgattctgattattccaagtggatggtattgaattcacgtaaaggatacttctactctatggcacatccagattattgtttacgtgttgctgatgttgatacaggttcactcgaattaggtaaatgtgatgaccaagcaaagatggtccatggtaatgatggattcttaggattgattgaatctagcgacaaatgcgtaggaattcttaatgctgaagatatgtataaagatgaaattaaaatgaacttgaacacttgtgctaaaaacgatgatgaaaagtt

SEQ ID NO: 26684 - DNA, 300 bp, Piromyces finnis; identical to SEQ ID NO: 26677
  Ricin B-like lectins

SEQ ID NO: 26685 - DNA, 426 bp, Piromyces finnis
  Ricin B-like lectins
tggttggtatttcattaaaaacccagaatctggtaaatatcttcaagtatctgctgccacaaatggtagttctggtggaaatcttgtaatttctaagggtactaaagatcaaggtcaaaaatggaaggtaactaatgttggtaagggtttagttacctttactactgctcttggtgattatatgattgatgttagtggtggtaagaatgaaaatggtactaatgttcaattatataacgcttatggtggtgatgcccaacaattcatgattttaaaaactactcaagaaaacgtttacaccattggtactaaagttagttattttgataaagctcttgatattgaaggcatgcgtactgaagatggtacaaatgtattacaatggaccaatgaaatgaaaccaaatcaaggttggagctttgaaag

SEQ ID NO: 26686 - DNA, 417 bp, Piromyces finnis
  Ricin B-like lectins
aaaggatggtaattattatatcaagagtgtatcttcaaacaagtatcttgttgtcaaggatggtataggagctaatgctcaaaatgttgaaattggttcaaccaaacaaaaatggaagatcagtaataatagtgatggtacagtttatatcattagtgaattaggtgattatgctttagatgttgacagaggtctcggtgataatggtgctaatatccaaatttatccacttcacggaggcgaagctcaaaagtttattattagggaaacttatccatccggtgtttatgttattgatactcaagcaagtaatggaagtaaagcacttgatattgaaggtgaaagaactgctgatggtacgaatgtatgtcaatggactgatggaggtaaggataatcaatcctggacttttatatc

SEQ ID NO: 26687 - DNA, 426 bp, Piromyces finnis
  Ricin B-like lectins
agatggttggtatttcattaaaaatccttcaactggaaagtatcttcaagttagagatgaagaaggaaaaaatgttgccaatattgaaattggctcaggacgtaaatctgatggacaaaaatggaaattaactaatgttggtgatggctatgtcacattaacctctgctcttggtgaatataatattgatattgctaatggtgaagataaaaatggagctaatgttcaaatctatgaagcatatggtggtgatgctcaacaatttgttattatgaccacttctacagataacgcctattccattggaactaaggcaagttcaggtgataaggttattgatattgaaggtggatatagtactgatggaaccaatgtttgtcaatggaagagtaacagtggaccaaatcaagtctggatttttgaaag

SEQ ID NO: 26688 - DNA, 417 bp, Piromyces finnis
  Ricin B-like lectins
tgctaatggtacctacaaaatcattaaccgtcaaagtggaaaagtattaagtgttaataacgattctactgctaacgctgctaatgtcattcaatggtccgaaagcaacaagagtagtcaacaatgggttattagtgaagaaggtgattactttagtttaataaatgttaatgccaagaaagctcttgatgtaaatgaaaattcaactgaaaatggtggtaatgtcattatctggccagatactggagcccttaaccaacgttggagtattcaaagtactggtgatggttattacaccattacaaatgccaacagtggaaagaatctcgatgttgaaaagggatctatgtctgatggtggtaatgttttacaatggggtaataatggtggtgctaatcaacaatggaagttagttcg

SEQ ID NO: 26689 - DNA, 417 bp, Piromyces finnis; identical to SEQ ID NO: 26688
  Ricin B-like lectins

SEQ ID NO: 26690 - DNA, 417 bp, Piromyces finnis
  Ricin B-like lectins
tccaaatggtacttataaaattattaaccgtcgtagtggaaaagctttaggagttattaacgattcaactgaagatagtgccaatgttcatcaatggactgataatggacataaaagtcaacaatgggttatttcaaatgaattcaatggaataaaaattgtcaacgttaatgcaaataaatgtttagatgttagcggaagatcaaaggataatggaggtaatattgttatttaccatgataatggatatatgaatcaacgttggactttccaagatgcaggtaatggttatattactattagaagttcacatagtggaaaacttattgatgttgataatagagcaacaacggatggtgcaaatgtacttcaatgggaaccaaatggtctagacaatcaacaatggaaacttgttaa

SEQ ID NO: 26691 - DNA, 312 bp, Piromyces finnis
  Ricin B-like lectins
tcaaaaatggaaacttactaatatgagtggtggttatgttactttagtcagtagtcttggtgaatatatgttagatattgctggtggtgatgatggaaatggtactaatgttcaaatttacagtgcatacgctggtgaagctcaacaatttgttattttaaagacatcaaaggataaggtttacactattggtactagagtttctaatggttacagagttcttgatgttgaaaagaatggtactactgatggtagcaatgttttacaatgggataactcagaaaagagtaatcaaacctggacttttgaatc

SEQ ID NO: 26692 - DNA, 429 bp, Piromyces finnis
  Ricin B-like lectins
tgaagatggttggtattacattaagaacccagcttcaggtaaatacctccaagttgctaataaccaagctaaggctacagccaatattgaaattggatcatctagtcaagatgatggacaaaagtggttacttactaatgttggtgaaggttatgttaccttaaagagtgctcttggcgatttcatgattgatgttagtagtggtgaagacaagaatggagccaatattcaaatctacactgcctatggtcacgatgctcaacaattcatgatcttaaaatctagtgttgaaggagcctacagtattacttcaagagttagtttccaagacaagggtattgatattgaaggagctcgtacagctgatggtaccaatgttttacaatggactagtgaaggtagagctaatcaattatgggcttttgaaaa

SEQ ID NO: 26693 - DNA, 429 bp, Piromyces finnis; identical to SEQ ID NO: 26692
  Ricin B-like lectins

SEQ ID NO: 26694 - DNA, 429 bp, Piromyces finnis; identical to SEQ ID NO: 26692
  Ricin B-like lectins

SEQ ID NO: 26695 - DNA, 420 bp, Piromyces finnis
  Ricin B-like lectins
tggatggtattacattaagaatactggatctaacaaatatcttcaagtaaagggtaataatggtgtagccaatactaatgtcgaaatcggaacctttgcaggtgcttctggacaaaaatggaaggttacacaaacaagtgatggttacattactttaactagtgctcttggaaactttatgttagatgtagctaatgctaaagatactgatggtaataatattcttatttatattggttacagtggtgatgcccaaaagttctctcttaaaccagctggtaattcattcattattactacaaaggttagtaatggtaaaaaagctttagatgtttataactttggaacatctgatggtactaatgtttgtcaatggactgttggtggtcaatccaaccaaacctgggtatttgaaccagt

SEQ ID NO: 26696 - DNA, 429 bp, Piromyces finnis; identical to SEQ ID NO: 26692
  Ricin B-like lectins

SEQ ID NO: 26697 - DNA, 420 bp, Piromyces finnis; identical to SEQ ID NO: 26695
  Ricin B-like lectins

SEQ ID NO: 26698 - DNA, 414 bp, Piromyces finnis
  Ricin B-like lectins
agatggatggtattacattaaaaacactggttccaacaagtatctttcagttaagggtgctgttggtgctaacggtcaaaatgttcaaattagttccactaaacaaaagtggaagatttacaataacaatgatggtactgttctcttaattagtgaatttggtgattatgctttagatgtcagtaacggttctggtgaaaatggtgccaacattcaaatttactctattcatggtggtgatgctcaaaagtttatcattagagaaacctttgaatctaatgtttacgttattgatactcaagctagtaatggtcaaagagctcttgacgttgaaggtgctagaactgatgaaggtactaacatttgccaatggtctgatgaagaaaagagtaatcaaacttggactattgaatc

SEQ ID NO: 26699 - DNA, 243 bp, Piromyces finnis
  Ricin B-like lectins
gattgatgttagtggtggtaagaatgaaaatggtactaatgttcaattatataacgcttatggtggtgatgcccaacaattcatgattttaaaaactactcaagaaaacgtttacaccattggtactaaagttagttattttgataaagctcttgatattgaaggcatgcgtactgaagatggtacaaatgtattacaatggaccaatgaaatgaaaccaaatcaaggttggagctttgaaag

SEQ ID NO: 26700 - DNA, 318 bp, Neocallimastix californiae
  RICIN_B_LECTIN
aactgctcgcaaatggaagcttactaatgttagtgatggttacgttacattaacaagtgaacttggtaactatatgttagatgttgctaatggtgaagatgttaacagtgctaaccttcaaatctacagtgcatatggtggtaatgctcaacaattcgttatcttaaaaacttctaattctaatgtttacactattggtactaaggcaagtagtggacaaagagttcttgatgttgaaaagagaggtaccactgatggtagtaacgttattcaatacgctcttaatggtgcttccaaccaaacatggacttttgaatc

SEQ ID NO: 26701 - DNA, 417 bp, Neocallimastix californiae; identical to SEQ ID NO: 26614
  RICIN_B_LECTIN

SEQ ID NO: 26702 - DNA, 417 bp, Neocallimastix californiae; identical to SEQ ID NO: 26614
  RICIN_B_LECTIN

SEQ ID NO: 26703 - DNA, 318 bp, Neocallimastix californiae
  RICIN_B_LECTIN
cactaagcaaaaatggaaaattacaaataatgatgatggtacagtttatattgtaagtgaatttggtaatttctctttagatgttgatagaggttccggtgacaatggtgccaacattcaaatttattctcatcacggaggagaagctcaaaaattcattattagagaaactaatcaatctggcgtttatgttattgatactcaagctagtaatggatatagagctcttgatgttgaaggtgagagaacttctgaaggtactaatgtttgtcaatgggatgattccggtaagagtaatcaaacttggacttttgaatc

SEQ ID NO: 26704 - DNA, 330 bp, Neocallimastix californiae
  RICIN_B_LECTIN
cggtagcaagtctgatggacaaaaatggaaggtaactaatgtaggtgatggttatgttaccttaacttccgctcttggtgattttaatattgatattgccaatggtgaagacaagaatggagctaatgttcaaatttatgatgcctatggtggtgatgctcaacaatttgttattatgactacctctactagtaacacatacactattggtactaaaattagtaatggtggaaaagctcttgatatagaaaatgacagtacttacgaaggtactaatgtttgccaatggactaacggtagtaagggaaatcaattatgggtctttgaaaa

SEQ ID NO: 26705 - DNA, 324 bp, Neocallimastix californiae
  RICIN_B_LECTIN
tactgactctgaacagatgtggaagcttaccaatcttggagataactacgttaccttaaccagtagtctcggtaatttcaacttagatatctgtatggctgaagatgaaaacggtacgaacgctcaaatttacaccgttcacaatgaagatccacaaaaattcgttattatggaaacgaaagacaaggatgtttacgtcatcggtacgaaaggtagtaatggttataaggttcttgatgttgaaagttatggtactactccaggaagtaacgtttaccaatgggaaaatgaaggtaaggacaaccaagtttggactttcgaact

SEQ ID NO: 26706 - DNA, 315 bp, Neocallimastix californiae
  RICIN_B_LECTIN
cactcaacaaaaatggaaacttaccaacaacagtgatggatcagttactttagttagtgaagttggagactttgctttagatgttagtggtggttcttctgataatggtgctaatgttcaaatctactctaactatggtggagatgcccaaaagttctatatcagagaagtttcatccaacgtctatactattaccactaaggtaagtaatggtgaaaaggctcttgatgccgaaggtgccagaacttctgacggtactaacattttacaatggacagatgaaggaaagagtaaccaaacttggacttttaaatc

SEQ ID NO: 26707 - DNA, 315 bp, Neocallimastix californiae; identical to SEQ ID NO: 26706
  RICIN_B_LECTIN

SEQ ID NO: 26708 - DNA, 315 bp, Neocallimastix californiae
  RICIN_B_LECTIN
tgatgcccaaaagtggaaggttactaacactaatggttatgttacctttacatctgctcttggtaattatatgattgatattgccaatggagaagatagaaacggagccaatgttcaaatttatgatgcctacggtggtgatgctcaacaattcattatctacaagactggtagagaaaatgtttacactattggtactaaggcttctgcaggagataaggctattgatattgaaggagcacgtaatggtgaaaacgttaatctcttacaatggactaatgaatataaggataaccaaacttggtcctttgaaaa

SEQ ID NO: 26709 - DNA, 318 bp, Neocallimastix californiae
  RICIN_B_LECTIN
ttctaaacaaaaatggaagcttaccaacaacagtgacaataccgttactttacttagtgaagttggagatttcatgttagatgttaatggtggcagtagtgataatggtgccaatattcaaatttacaatgcttatggtggagatgctcaaaaattcgtcattagagaaacttctcaagctaatgtatatgttgtcagtactaaggtttcaagtggttacaaggttcttgatgttgaaaatgaaggtaaatacgatggtagtaacatttgtcaatgggaaaatggtgaaagaagtaatcaaacttggacttttgaatc

SEQ ID NO: 26710 - DNA, 321 bp, Neocallimastix californiae
  RICIN_B_LECTIN
ttcttctaagcaaaaatggaagcttaccaacaataatgataataccgttaccttacttagtgaagttggagatttcatgttagatgttaatggaggtagtgacaagaataatgctaatattcaaatttatcatgcttatggtggagatgctcaaaaattcatcattaaagaaacttcacaaagtaatgtatatgttataactactaaagtttctaatggtagcaaagctcttgatattgaaaaggaaggtaaaaacgatggtagtaacgtcttacaatgggataatggtacaaaaagtaatcaaacttggatttttgaatc

SEQ ID NO: 26711 - DNA, 318 bp, Neocallimastix californiae
  RICIN_B_LECTIN
tactaaacaaaaatggaagcttaccaacaatgatgacaatactgttactttacttagtgaagttggagatttcatgttagatattgacagaggtcttgaagaaaatggtgctaatattcaaatctaccatgcttacggtggagatgcccaaagatttatcattaaagaaactggtaagtctaaggtttatgtcatcagttctaagattactaatggttacaaggttcttgatgttgaaaatcaagcaactgctgatggtagtaatgtttgtcaatgggaaaatggtgaaagaagtaatcaaacttggacttttgaatc

SEQ ID NO: 26712 - DNA, 315 bp, Neocallimastix californiae
  RICIN_B_LECTIN
tgctcaaaagtggaaacttgaaaatgttggaaacggttacgtaactttagttagtatgtatggtaactacatgttagatattgctaatggagaagataaagatggttctaaccttcaaatatactctgcttatggtggtgatgctcaacaatttataattttgaagactcctcagaataatgtatatgcaattggtactaaggctagtgaaggtactaaagtacttgatattgaaggtggaagaacatccgaaggttctaatgttttacaatggactaatggcggaaagagtaatcaaacttggacttttgaatc

SEQ ID NO: 26713 - DNA, 417 bp, Neocallimastix californiae
  RICIN_B_LECTIN
tgatggttggtactatattaagaacactggctctaacaagtatctccaaactgttggttccactgctaattcaaatgtagaaattagttcattcactggttctgctgcacaaaaatggaaggtaactaagaatagtgaaggatacattacattacttaatggtgttggtgatttcaatttagatgtagccaacggtaagaatgaaaatggtgtaaatattttaatttatatcgcttatggtggtgaagctcaacaatttgctctctctgctggaagtaacaattctttcattatcacaactagagttagtaatggtgataaggccttagatgtatatgaacacagaaccgaagatggtgcaaatgtttgccaatggacaacttcaggtaaaccaaaccaaacttgggtattcgaaaa

SEQ ID NO: 26714 - DNA, 321 bp, Neocallimastix californiae
  RICIN_B_LECTIN
ttctagaaaacaaaaatggctacttactaatgttggtgatgatgaagttactttaactactgaacttggtaattatatgttagatgttaattctggtagtgaaaataatggagcaaacattcaaatctataatagtcatggaggagattctcaaagattcattattgaagaaacttatcaaagtgatgtttatgtcattggtacaaaggtaactaatggttataaggttattgatgttgaaagagaaggtaaggacgatggtagtaatgtttgtcaatgggataatggtgaaaaaccaaaccaaacttgggtattcgaatt

SEQ ID NO: 26715 - DNA, 414 bp, Neocallimastix californiae
  RICIN_B_LECTIN
tggtggtaagtacaacatcgttaatcgtaacagtggtaagttcttaggtgttaacaatgactctacttctgatggtgctaatgttcatcaatggtctgacaatggaaagactagtgaacaatggattatcagtgatgaaggtaatggttacaagattcttaatgtcaatgccaataaggttcttgatgttaacgatgcttcctattctgatggtgccaatgttattctctggagcgataatggtaactctaaccaacgttggattattcaagaacttggtgatggatatgtcactattgaaaactataacagtggtaagaaccttgatgttgaaaagtcatctacttctgatggtggtaatgtcttacaatggagtaacaatggtcaaaacaaccaacaatggaagttagttcg

SEQ ID NO: 26716 - DNA, 318 bp, Neocallimastix californiae
  RICIN_B_LECTIN
ttcaaaacaaaaatggaaggttacaaaaaataatgatggttccgttgtaataatttctgaatttggtaacttcgctttagatattgcaaatggttctggagataatggagctaatgttcaaatttacactactcatggtggtgatgctcagaagtttattattagagaaacttctaactctggtatattcgttattgatactattgctagtggtggttctaaagctttagatattgaaggtggtcgtagtgctgatggtactaacatttgtcaatgggatgattctgcaaagagtaatcaaacttggacttttgaagc

SEQ ID NO: 26717 - DNA, 411 bp, Neocallimastix californiae
  RICIN_B_LECTIN
agaaggtacatataaattaattaaccgtcgtagtaacaaggctttagctgttcaaaatgactccaaggataacgctgctaacgttgttcaatggactgaaagtaataaaactagtcaacaatggaagattactgaagatggaggttacagaatcttaaatgtcaatgccgataaagcccttgatgttgaaagagattcaactcaaaatggtggtaatattatcatttggcctgataccggtaacctcaatcaacgttggactattgaagatgctggaaatggttatgttgaaatcgttaatcttagtagtggtaaagctcttgacgttgaaaatgaatccactgctgatggtgccaatgtttgtcaatgggatgctcatggtagtcaaaaccaacaatggaaattagttcc

SEQ ID NO: 26718 - DNA, 321 bp, Neocallimastix californiae
  RICIN_B_LECTIN
taatgctcaaaaatggaaacttgaaaatgttgatgaggaatatattactttattaactatgtatggaaactatatgattgatgtagctaatggtgaagataagaatggatcgaatattcaaatttatagtgcttatggtggtgatgctcaacaatttactcttataaagacatcaaaagaaaatgtttatgtaattggtactaaagtatctcaaggtgctagagttttcgatgttgaaagtgccagtactgctgaaggaagtaatgttttacaatggagtaatggtggtgaaagatctaatcaaacttggcttttcgaaaa

SEQ ID NO: 26719 - DNA, 411 bp, Neocallimastix californiae
  RICIN_B_LECTIN
agatggtacctaccgaattattaatcgtaacagtggaaaagctttatctgttgttaatgattccaagaataatgcagctagtgtggttcagtatacttacacgggtaagagtagtcaacaatggaagattgttgaagatggaggttacagtttcaccaatgttaattctaataaagtacttgatatgaatggagcctctcttgaagatggaggtaatgctattatttggccagatattgctggtccaaatcaacgttggtctattgaaaatgctggagatggttatgtctatattattaactttaatagtaataaagtccttgatgttgccaatgtttcaaaggaagaaggaggaaatgttcatcaatggaccatcacaaatggtgccaatcaacaatggcaattaattcc

SEQ ID NO: 26720 - DNA, 414 bp, Neocallimastix californiae
  RICIN_B_LECTIN
tggtgacagatacaagatcattaatcgttacactaacagagttttagctgttgaaaacgattccaccgctaataatgccaatgttctccaatggggtgacaatggaagttccggtcaacaatgggttgttgctaaggaaggtgatcaatacagaattactagctatactaccaacaaggccttagatgtcagtggaagatcaactgccgatggtggtaatgttattatttatgatgataaggctcaaggtaatcaacgttggaagtttattgatgccggtgatggttatgttatcattgaaaatgtaaatagtggaaaggttcttgatgttgataacgcctcaaaggaatatggtgctaatattatgcaatggagaaagaatggtagtactaaccaacaatggaaattagttcc

SEQ ID NO: 26721 - DNA, 327 bp, Neocallimastix californiae
  RICIN_B_LECTIN
aacaaaatctgatggtcaaaaatggaaagttacaaacgttggtgatggatacattactttaactactgctcttggtgacttcaatattgatattgccaatggtgatgataaaaacggagccaatgttcaaatctatgatgcctacggtggaaatgctcaacaatttgttgttatgactacttctgacagtaatacctatactataggttctaaggtcagtagtggtggtaaagctcttgatattgagaatgaaagtacctcagatggtgccaacgtttgtcaatggacaaacagtagtaagggtaaccaattatgggtctttgaaaa

SEQ ID NO: 26722 - DNA, 291 bp, Neocallimastix californiae
  RICIN_B_LECTIN
tgaaggttatgttactttagtatctatgtatggtaattacatgttagatattgccatgggtgaagataagaatggagcaaacattcaaatttacgatgcttatggtggagacgcccaacaattctctcttattgaaacttctaagaagggagtttacgttattgctacaaaagttagtcaaaatgataaatgtcttgatgtcgaaagtgctagtaccgcagaaggtagtaacgttttacaatggacaaacggtggtgaaagaagtaatcaaacttggtctttcgaatctgt

SEQ ID NO: 26723 - DNA, 318 bp, Neocallimastix californiae
  RICIN_B_LECTIN
caatgctcaaaaatggaaaattcaaaatattggagatggctatgttactattctttccatgtatggtgattatatgttagatgttgccaatggtgaagatgtagatggtgctaatgttcaaatttattcttcctatggtggtgatccacaacaatttattattgctgaaacttcaagaagtaatgtatatgttattggtagtaaagttagtgaaggtaataaggttattgatattgaacatgaaagtactgaagaaggtagtaatgttcatcaatggactaacagtgaaaagagtaatcaaacatgggttatagaatc

SEQ ID NO: 26724 - DNA, 414 bp, Neocallimastix californiae
  RICIN_B_LECTIN
tggtggtaaatacaagattgttaaccgtaacagtggaaaagttttagctgttgttagtgattctacttcaaatggagctgatgtcattcaatggtctgataatggaaagactagtcaacaatgggtcatcacagatgaaggcaatggttataagattatgaatgttaatgctaataaggctcttgatgtcagtgaaaattcagtgaaggatggtggtgatgttattatctggagtgataatggccataataaccaacgttggaatatccaagatgttggtaatggttatgttactattaaaaacgtcaacagtggtaagaaccttgatgttgagaaggaatctacctctgatggagctgatgttatacaatggggtaataatggtaacagtaaccaacaatggaaattagttgc

SEQ ID NO: 26725 - DNA, 414 bp, Neocallimastix californiae; identical to SEQ ID NO: 26638
  RICIN_B_LECTIN

SEQ ID NO: 26726 - DNA, 426 bp, Neocallimastix californiae
  RICIN_B_LECTIN
agatggatggtattttattaaaaattcaagttctggaaaataccttcaggtaagtaatgaaaattctagagctgcttcaaatattgaaattggttctagtcgtaaatctgatggtcaaaaatggaagctaactaatgttggtgatggttatgttactctaacttcagctctcggtaattttaatgttgatgttgctaatggagaagataaaaacggtgctaatattcaaatttatgatgcttatggtggtaatgctcaacaatttattattatgactacttcattctctaatgtttatactatcggaaccaaagttagtaatggtgaaaaggctcttgatgttgaaaatggaagtaaatctgatggtgccaacgtaattcaatggaaaaatgaaagtaaggataatcaaagttggatttttgaaaa

SEQ ID NO: 26727 - DNA, 327 bp, Neocallimastix californiae
  RICIN_B_LECTIN
aaccaaagacaatggtcaaaagtggaaacttaccaatgttagcaatggtttagttactttaacatcatcacttggtaattataatattgatgttgctaatggaaaagattctaatggtaataatattatattatataattcttatggtggtgaaccgcaacaattcatgattttaaaaacttcccaaaaaaatgtttatactattggtacaaaagtaagtaacttcgataaagcttttgatattgaaaatggaagatcaactgatggcacaaatgttttacaatggactaatgaaatgaaacctaaccaactttggatgtttgaaaa

SEQ ID NO: 26728 - DNA, 324 bp, Neocallimastix californiae
  RICIN_B_LECTIN
ataccaagaagacaatcaaaagtggaaggttactaacgctggtaatggttacattactttaactagtggtcttggtgactatatgttagatgttgccaatggttctgctaataatgatgctaacattcaagtttatagtgcctatggaggagatgctcaacaattcaaacttgttgaatacggtagtggtgaatttgctattgttactaagtctagtaacgatggtaaggctgttgatattgccaacaacggttacactgatggtactaatgttttacaatggactaacagtggtaagagcaaccaaatttgggtattcgaaaa

SEQ ID NO: 26729 - DNA, 393 bp, Neocallimastix californiae
  RICIN_B_LECTIN
tggtaaataccttcaagttgctaacgaaaatggtaaaaatgttgccaatattgaaatcggtacaggcagacaatctgatggtcaaaaatggaaacttactaatgttggtaatggttatgttactttaacttcagcccttggtgaattcaacattgatattgccaatggagaaaacaaagatggaactaatgtacaaatttatgaagcctatggtggtgaagctcaacaattcgttattttaactacatacactgatgatgtttacactattggtactagagtcagtaatggtgataaagctcttgatattgaaggaggtcgtaattcagacggtactaatgttttacaatggaccaatggtagcaaaggaaatcaaagttggattttcgaaaa

SEQ ID NO: 26730 - DNA, 444 bp, Neocallimastix californiae
  RICIN_B_LECTIN
aggtgctcaacttagagatggttggtattttattaagaatccagcttctggtaaatatcttcaagtttcaggtgccactaatggtggtgctggaggtaatgtagttatttcaacaggaactaaggataatggtcaaaaatggaaaattactaatgtaggtaatggtttagttactttcaccactgcacttggtgattatatgattgatgttgaagcaggttcaggtaagaatgatgccaatattcaattatataatgcttatggtggtgatgctcaacaatttatgattttaaagacaactgaaaaagatgtttatactattggtactaaagttagttactttgataaagctcttgatatagctcaagctaaaactgctgatggtacaaatgtcgttcaatggactaatgaaatgaaagctaatcaaagttggacctttgaaag

SEQ ID NO: 26731 - DNA, 318 bp, Neocallimastix californiae
  RICIN_B_LECTIN
ctcagctcaaaaatggaagcttactaacaccgacgatggatatattactttagttagtgaactcggaaattacatgatcgatgtagcaaatggtagtggtgaaaataacgctaatgttcaaatctatgatgcttatggaggagatgctcaaaaattcgttcttttaaagacttctcaatccaacacttacgttattgctactaaagcaagtaatggatacagagttcttgatattgaaaagaatggtactgctgaaggtagtaatgttttacaatgggataaccaagaaaaggctaatcaattttgggttttcgaaaa

SEQ ID NO: 26732 - DNA, 309 bp, Neocallimastix californiae
  RICIN_B_LECTIN
aaaatggaaacttgaaaatgttggtgatggttatgttactttacttactatgtatggtgactacatgttagatgtagctgctggtgatagtaaagatggtgctaacattcaaatttattctgcttatggtggtgatgctcaacaatttgctattattccaacttctaacggtaatacttatgttattggtagtaaggttagtaatggtgaaaaagttcttgatattgaaaaagctagtacttctgaaggtagtaatgttttacaatgggttaatggtgaaaaagctaatcaaacttggatttttgaatc

SEQ ID NO: 26733 - DNA, 321 bp, Neocallimastix californiae
  RICIN_B_LECTIN
ttccacaaaacaaaaatggaagatttcaaataatgatgatggtactgttttaattattagtgaacttggagattatgctttagatgttagtgctggtagtagtaataatggagctaatattcaaatttattccgcctatggtggtgaagctcaaagatttattattagagaaacttatacctcaggaaattatgttattactactaaagttactaatggtagtagagctcttgatgttgaaggtaataaaactgcagaaggtacaaatatatgtcaatgggatgatggtgaaaaatctaatcaaatttggactcttgaagc

SEQ ID NO: 26734 - DNA, 321 bp, Neocallimastix californiae
  RICIN_B_LECTIN
ttctgatgctcaaaaatggaaacttgaaaatgttggtaatggttacatgactttaacctccatgtacggtgattacaaaattgatattgctggtgctgatgattctaatggttctaatgttcaaatttacactactcacggtgaagataatcaacaatttattgttttaaagacttcaaaggataatgtttatgctattggtactaagattactaatggtgaaagagttcttgatgttgaaagtgaaagtacttctgctggtagtaatgttcaccaatggttaaatagtgaaaagagtaatcaaacttggacatttgaagc

SEQ ID NO: 26735 - DNA, 417 bp, Neocallimastix californiae
  RICIN_B_LECTIN
agaaggtacttacaagattgttaatcgtaaaagtggaaaagtattagctgttgctaatgattctaaggcaaatgctgctaatgttcatcaatggacttacattgatggtaatgctagtcatcattggaagatttctgaagatggaggttacagaattctcaatgttaatgccaataaagtacttgatatgaatgcagaatctaccgctgatggaggtaatgctattatatggccagatactggaggtatgaatcaacgttgggttattgaaagtgctggaggtaattatgtttatattataaactctcacagtggaaaagctcttgatgttgataagagttcaaatgatgatggaggtaatattattcaatggagtcttagtaataatagttcaaaccaacaatggcaattaattcc

SEQ ID NO: 26736 - DNA, 321 bp, Neocallimastix californiae
  RICIN_B_LECTIN
ttcaaatgcttcaaagtggaagcttactaatactaatgatggttacattaccttaactagtagtgttggaaactatatgttagatgttgctggtggtgaagataaaaatggagttaatcttcaaatttacagtgcttatagtggagatgctcaaaaattcgtcatattaaagacttctaataataaggtatacactattggatccaaggttagtaatggcggtaaagttattgatgttgaaaaaagaggtacgactgatggaagtaatgttattcaatacgctcttaatggtgcttctaatcaaacttggacatttgaatc

SEQ ID NO: 26737 - DNA, 321 bp, Neocallimastix californiae
  RICIN_B_LECTIN
ttccaaaaaacaaaaatggaaggttatgaatactagtgaaggtacagttaccatggaaagtgaacttggtaattatatgattgatgttaatggtggtagtgaagccaatggtgctaatattcaaatttatgaatcttatggaggagatgcccaacaattctatattagagaaacttatcaaaagaatgtttattctattggtactaaacttactggtggatacaaagttcttgatgtagaaaaggaaggtaagactgatggtagtaatgtatgtcaatgggaagatggaggtagatccaatcaaacctggttatttgaatt

SEQ ID NO: 26738 - DNA, 432 bp, Neocallimastix californiae
  RICIN_B_LECTIN
ttcttctgttgttgcttctggtggtaaatacaaacttattaatcgtaacagtggaaaagcattaggtgttgatggtgattctacttcaaatgctgctaatgttcaccaatggactgataatggtaaaactagtcaacaatggattattactgatgaaggttatggttataagatcatgaatgttaatgctaataaggcacttgatgttaatgaaaattctacaaagaatggtggtaatgttattatttggtctgataatggaaatcttaatcaacgttggtatattgaagaaattggtgatggatatattactttacaaaatattaatagtggattattacttgatgtagaaaagtcatctacctctgatggtggtaatgtattacaatgggaaaataatggtaatagtaatcaacaatggaaattaatacg

SEQ ID NO: 26739 - DNA, 393 bp, Anaeromyces robustus; identical to SEQ ID NO: 26729
  RICIN_B_LECTIN

SEQ ID NO: 26740 - DNA, 324 bp, Anaeromyces robustus; identical to SEQ ID NO: 26728
  RICIN_B_LECTIN

SEQ ID NO: 26741 - DNA, 309 bp, Anaeromyces robustus; identical to SEQ ID NO: 26732
  RICIN_B_LECTIN

SEQ ID NO: 26742 - DNA, 318 bp, Anaeromyces robustus; identical to SEQ ID NO: 26731
  RICIN_B_LECTIN

SEQ ID NO: 26743 - DNA, 444 bp, Anaeromyces robustus; identical to SEQ ID NO: 26730
  RICIN_B_LECTIN

SEQ ID NO: 26744 - DNA, 321 bp, Anaeromyces robustus; identical to SEQ ID NO: 26734
  RICIN_B_LECTIN

SEQ ID NO: 26745 - DNA, 321 bp, Anaeromyces robustus; identical to SEQ ID NO: 26733
  RICIN_B_LECTIN

SEQ ID NO: 26746 - DNA, 417 bp, Anaeromyces robustus; identical to SEQ ID NO: 26735
  RICIN_B_LECTIN

SEQ ID NO: 26747 - DNA, 432 bp, Anaeromyces robustus; identical to SEQ ID NO: 26738
  RICIN_B_LECTIN

SEQ ID NO: 26748 - DNA, 324 bp, Anaeromyces robustus
  RICIN_B_LECTIN
ttccactaaacaaaaatggaaagttactaatatggatgataatactattacattacttagtgaacttggagattatatgttagatgttagtagtggtagtagtgaaaatggagctaatattcaaatttatgatgcttatgctggagatgctcaaaaatttgttcttagagaaacttctaaagaaggagtttatgttattagtaccaaggttagtaatggttataaagttcttgatgtagaaagagaaggtaaaagtgatggtagtaatgtttgtcaatgggataatggaggtgaaaaagctcatcaaacttgggtatttgaatc

SEQ ID NO: 26749 - DNA, 411 bp, Anaeromyces robustus
  RICIN_B_LECTIN
agaaggtacttacagaattattaaccgtaacagtggaaaagctttatcagttgctaatgattccaagaataatgctgctaatgttcatcaatggacctacagtaataaagctagtcaacaatggaagattactgaagatggaggttacagaattcttaatgttaatgccaataaagtacttgatatggataatgaatcattaaaagatggaggtaatgcccttatatggccagatactggagcattaaatcaacgttggcttattgaagatgctggtaatggatatgttaatattataaactataatagtgaaaaagctcttgatgttgaaaagaattcaaatgctgatggaggtaatgtcattcaatggacacttactaatagtgcaaaccaacaatggcaattaattcc

SEQ ID NO: 26750 - DNA, 312 bp, Anaeromyces robustus
  RICIN_B_LECTIN
aaaatggaaacttgaacatgttgatgatgattatttcacattagcttctatgtatggtgattatatgttagatgttaatagaggtgaaaataaagatggtgcaaatattcaagtttattctgcttatggtggtgatgctcaacaatttagtgttgtaaaaacatctaaagaaaatgtttatgcaattgctacaaaaatttctagaggtactaaagttcttgatattgaattagcaagtacagctgatggtagtaatgtctgtcaatggactaatggtggtgaaaagaatcatcaagtatggacttttgaatc

SEQ ID NO: 26751 - DNA, 414 bp, Anaeromyces robustus
  RICIN_B_LECTIN
tggtggtatttataaacttcttaatcgtaatagtggaaaagctttaggtattgaaagtgattctactacagatggtgctaatgttcatcaatggactgataatagtagaactagtcaacaatggatatttatagatgaaggtaatggttataagatcatgaatgtaaatgctaaaaaagctcttgatatttatggaagttctgtagaaaataatggtaatgctattattatgaccgataatggaaattcaagtcaacgttggactgttaaagatcttggtgatggatattacattattcaaaacgttaatagtggattattacttgatgttgaaagaaaatctacagctgatggtggtaatgtattacaatggccaaataatggtaatagtaatcaacaatggaaattagttcg

SEQ ID NO: 26752 - DNA, 414 bp, Anaeromyces robustus
  RICIN_B_LECTIN
tggaaatacttttaaaattattaatcgtttaagtggtaaagcattatcagttaatggtgattctacagctaatgaagccaatgttattcaatggaccgataatggtaaaacaagtcaacaatggattattacccaagaatcaaatggatataagattatcaatgttaatgctaataaagctcttgatgtttataaaaattcaagagataatggtggaaatgttattatttggtatgataatggtgcatctaatcaacgttggaatattcaagaagttggtaatggatattatactttacaaaatcttaatagtggaaaattacttgatgttgaaaaagaatcaagaaatgatggaggaaatgttttacaatgggttaataatggtaatacaaatcaacaatggcaaattgttag

SEQ ID NO: 26753 - DNA, 315 bp, Anaeromyces robustus
  RICIN_B_LECTIN
taacgctcaaaaatggaaacttgaaaatgttagtgatggttatgttactttacttactatgtatggggattatatgttagatgttgcagcaggtgaagataaggatggtgctaatcttcaaatttattcttcttatggtggtgataatcaacaattttcaattttaaagatttctgatgatgtttatgctattgctactaaagttagtgatagtactaaagttcttgatgttgaaaaagctagtactactgatggaagtaatgttttacaatggaaaaataaagaaacaagtaatcaaacttggatttttgaatc

SEQ ID NO: 26754 - DNA, 318 bp, Piromyces finnis
  RICIN_B_LECTIN
aagtgctcaaaaatggaaacttactaatgttgataatggatatgtcaccttagttagtatgtacggaaattacatgttagatgttgccaatggtgattccaagaatggagctaaccttcaaatctacacttctcatggtggtgatgctcaacaatttatcttcttaaatacctcaaagaataatgtttacgttattggtactaaggccagtagtggtactaaggttcttgatattgaaagtgaaggtactgccgatggaagtaacattttacaatgggaaaatggtgaaaagagcaaccaaacttgggttattgaatc

SEQ ID NO: 26755 - DNA, 309 bp, Piromyces finnis
  RICIN_B_LECTIN
aaagtggttaattactaatatggatgatgatactattaccatacttagtgaacttggtaattacatgctagatgttaatggtggtagtgataaaaatggtgctaatattcatatatatgatgcttattctggagaccctcaaagattcattattagtgaaacttatcaaagtaatgtttataccattggtactaaagttacttatggtgaaaaagttcttgatgttgaaaatgaaggcaaatctgatggtagtaatgtttgtcaatgggaaaatggtgaaagatcaaatcaaacctgggtatttgaatt

SEQ ID NO: 26756 - DNA, 324 bp, Piromyces finnis
  RICIN_B_LECTIN
ttcaaaagcacaaaaatggaaacttgaaaatgttggagaaggttatgttaccttactttctatgtatggtgattttatgattgatgtagctatgggtgaagataaggatggttctaacattcaaatttacactgcttatggtcatgatgctcaacaatttactattataaaaacaacaaaggaaaacgtttatataattggtaccagagtctctgaaggtggtaaagtattagatgttgaaagagaaggcactgcagatggtagtaatgtcgttcaatggactggtggtggtgaaaagggtaatcaaacttggcttttcgagtc

SEQ ID NO: 26757 - DNA, 396 bp, Piromyces finnis
  RICIN_B_LECTIN
tggtaaatatcttcaagtatctgctgccacaaatggtagttctggtggaaatcttgtaatttctaagggtactaaagatcaaggtcaaaaatggaaggtaactaatgttggtaagggtttagttacctttactactgctcttggtgattatatgattgatgttagtggtggtaagaatgaaaatggtactaatgttcaattatataacgcttatggtggtgatgcccaacaattcatgattttaaaaactactcaagaaaacgtttacaccattggtactaaagttagttattttgataaagctcttgatattgaaggcatgcgtactgaagatggtacaaatgtattacaatggaccaatgaaatgaaaccaaatcaaggttggagctttgaaag

SEQ ID NO: 26758 - DNA, 318 bp, Piromyces finnis
  RICIN_B_LECTIN
aaccaaacaaaaatggaagatcagtaataatagtgatggtacagtttatatcattagtgaattaggtgattatgctttagatgttgacagaggtctcggtgataatggtgctaatatccaaatttatccacttcacggaggcgaagctcaaaagtttattattagggaaacttatccatccggtgtttatgttattgatactcaagcaagtaatggaagtaaagcacttgatattgaaggtgaaagaactgctgatggtacgaatgtatgtcaatggactgatggaggtaaggataatcaatcctggacttttatatc

SEQ ID NO: 26759 - DNA, 330 bp, Piromyces finnis
  RICIN_B_LECTIN
aggacgtaaatctgatggacaaaaatggaaattaactaatgttggtgatggctatgtcacattaacctctgctcttggtgaatataatattgatattgctaatggtgaagataaaaatggagctaatgttcaaatctatgaagcatatggtggtgatgctcaacaatttgttattatgaccacttctacagataacgcctattccattggaactaaggcaagttcaggtgataaggttattgatattgaaggtggatatagtactgatggaaccaatgtttgtcaatggaagagtaacagtggaccaaatcaagtctggatttttgaaag

SEQ ID NO: 26760 - DNA, 414 bp, Piromyces finnis
  RICIN_B_LECTIN
taatggtacctacaaaatcattaaccgtcaaagtggaaaagtattaagtgttaataacgattctactgctaacgctgctaatgtcattcaatggtccgaaagcaacaagagtagtcaacaatgggttattagtgaagaaggtgattactttagtttaataaatgttaatgccaagaaagctcttgatgtaaatgaaaattcaactgaaaatggtggtaatgtcattatctggccagatactggagcccttaaccaacgttggagtattcaaagtactggtgatggttattacaccattacaaatgccaacagtggaaagaatctcgatgttgaaaagggatctatgtctgatggtggtaatgttttacaatggggtaataatggtggtgctaatcaacaatggaagttagttcg

SEQ ID NO: 26761 - DNA, 414 bp, Piromyces finnis; identical to SEQ ID NO: 26760
  RICIN_B_LECTIN

SEQ ID NO: 26762 - DNA, 414 bp, Piromyces finnis
  RICIN_B_LECTIN
aaatggtacttataaaattattaaccgtcgtagtggaaaagctttaggagttattaacgattcaactgaagatagtgccaatgttcatcaatggactgataatggacataaaagtcaacaatgggttatttcaaatgaattcaatggaataaaaattgtcaacgttaatgcaaataaatgtttagatgttagcggaagatcaaaggataatggaggtaatattgttatttaccatgataatggatatatgaatcaacgttggactttccaagatgcaggtaatggttatattactattagaagttcacatagtggaaaacttattgatgttgataatagagcaacaacggatggtgcaaatgtacttcaatgggaaccaaatggtctagacaatcaacaatggaaacttgttaa

SEQ ID NO: 26763 - DNA, 312 bp, Piromyces finnis; identical to SEQ ID NO: 26691
  RICIN_B_LECTIN

SEQ ID NO: 26764 - DNA, 447 bp, Piromyces finnis
  RICIN_B_LECTIN
gccagttgccgtcaagattgaagatggttggtattacattaagaacccagcttcaggtaaatacctccaagttgctaataaccaagctaaggctacagccaatattgaaattggatcatctagtcaagatgatggacaaaagtggttacttactaatgttggtgaaggttatgttaccttaaagagtgctcttggcgatttcatgattgatgttagtagtggtgaagacaagaatggagccaatattcaaatctacactgcctatggtcacgatgctcaacaattcatgatcttaaaatctagtgttgaaggagcctacagtattacttcaagagttagtttccaagacaagggtattgatattgaaggagctcgtacagctgatggtaccaatgttttacaatggactagtgaaggtagagctaatcaattatgggcttttgaaaa

SEQ ID NO: 26765 - DNA, 447 bp, Piromyces finnis; identical to SEQ ID NO: 26764
  RICIN_B_LECTIN

SEQ ID NO: 26766 - DNA, 447 bp, Piromyces finnis; identical to SEQ ID NO: 26764
  RICIN_B_LECTIN

SEQ ID NO: 26767 - DNA, 303 bp, Piromyces finnis
  RICIN_B_LECTIN
aaaatggaaggttacacaaacaagtgatggttacattactttaactagtgctcttggaaactttatgttagatgtagctaatgctaaagatactgatggtaataatattcttatttatattggttacagtggtgatgcccaaaagttctctcttaaaccagctggtaattcattcattattactacaaaggttagtaatggtaaaaaagctttagatgtttataactttggaacatctgatggtactaatgtttgtcaatggactgttggtggtcaatccaaccaaacctgggtatttgaacc

SEQ ID NO: 26768 - DNA, 447 bp, Piromyces finnis; identical to SEQ ID NO: 26764
  RICIN_B_LECTIN

SEQ ID NO: 26769 - DNA, 303 bp, Piromyces finnis; identical to SEQ ID NO: 26767
  RICIN_B_LECTIN

SEQ ID NO: 26770 - DNA, 321 bp, Piromyces finnis
  RICIN_B_LECTIN
ttccactaaacaaaagtggaagatttacaataacaatgatggtactgttctcttaattagtgaatttggtgattatgctttagatgtcagtaacggttctggtgaaaatggtgccaacattcaaatttactctattcatggtggtgatgctcaaaagtttatcattagagaaacctttgaatctaatgtttacgttattgatactcaagctagtaatggtcaaagagctcttgacgttgaaggtgctagaactgatgaaggtactaacatttgccaatggtctgatgaagaaaagagtaatcaaacttggactattgaatc

SEQ ID NO: 26771 - DNA, 309 bp, Neocallimastix californiae
  RicinB_lectin_2
caaatggaagcttactaatgttagtgatggttacgttacattaacaagtgaacttggtaactatatgttagatgttgctaatggtgaagatgttaacagtgctaaccttcaaatctacagtgcatatggtggtaatgctcaacaattcgttatcttaaaaacttctaattctaatgtttacactattggtactaaggcaagtagtggacaaagagttcttgatgttgaaaagagaggtaccactgatggtagtaacgttattcaatacgctcttaatggtgcttccaaccaaacatggacttttgaatc

SEQ ID NO: 26772 - DNA, 270 bp, Neocallimastix californiae
  RicinB_lectin_2
cactgatggttggtactatattaagaacactggatctgacaagtaccttcaagctaatggttctagtgctggtgccaatgttgaaattggttcattcactggttattccgatcaaaagtggaaggttactactaatggtgaaggttacattactttacttaatggtaatggaaactttaacttagatgttgatagtgctaagaatgaaaatggtgccaacattttaatttatgatgcttacggtggtgttgcccaacaatttgctcttac

SEQ ID NO: 26773 - DNA, 270 bp, Neocallimastix californiae; identical to SEQ ID NO: 26772
  RicinB_lectin_2

SEQ ID NO: 26774 - DNA, 309 bp, Neocallimastix californiae
  RicinB_lectin_2
aaaatggaaaattacaaataatgatgatggtacagtttatattgtaagtgaatttggtaatttctctttagatgttgatagaggttccggtgacaatggtgccaacattcaaatttattctcatcacggaggagaagctcaaaaattcattattagagaaactaatcaatctggcgtttatgttattgatactcaagctagtaatggatatagagctcttgatgttgaaggtgagagaacttctgaaggtactaatgtttgtcaatgggatgattccggtaagagtaatcaaacttggacttttgaatc

SEQ ID NO: 26775 - DNA, 270 bp, Neocallimastix californiae
  RicinB_lectin_2
ggatggttggtatttcattaagaatccaaaatctggattatatcttcaagttagtaatgaagaagctagagctgtagctaatattgaaattggttccggtagcaagtctgatggacaaaaatggaaggtaactaatgtaggtgatggttatgttaccttaacttccgctcttggtgattttaatattgatattgccaatggtgaagacaagaatggagctaatgttcaaatttatgatgcctatggtggtgatgctcaacaatttgttat

SEQ ID NO: 26776 - DNA, 279 bp, Neocallimastix californiae
  RicinB_lectin_2
caagccaaagaagatggctgatggttggtacaagattaagaaccccgtttccggtttataccttcaagttgccaatgctgaaggggccgacgctcaaaatgttgaaattggtactgactctgaacagatgtggaagcttaccaatcttggagataactacgttaccttaaccagtagtctcggtaatttcaacttagatatctgtatggctgaagatgaaaacggtacgaacgctcaaatttacaccgttcacaatgaagatccacaaaaattcgttat

SEQ ID NO: 26777 - DNA, 273 bp, Neocallimastix californiae
  RicinB_lectin_2
taaaataaatgatggttggtattacattacaaatactaattcaaataagtatcttagtgttagaaatggtgttggagctaatagtcaaaatgtcgaacttggttccactcaacaaaaatggaaacttaccaacaacagtgatggatcagttactttagttagtgaagttggagactttgctttagatgttagtggtggttcttctgataatggtgctaatgttcaaatctactctaactatggtggagatgcccaaaagttctatatcagaga

SEQ ID NO: 26778 - DNA, 273 bp, Neocallimastix californiae; identical to SEQ ID NO: 26777
  RicinB_lectin_2

SEQ ID NO: 26779 - DNA, 273 bp, Neocallimastix californiae
  RicinB_lectin_2
tgaagatggttggtattacattaagaatccaagcactggaaagtacattcaagttgaagatggtgttggtcgtaatagtgctaatgttgttattggttctgaacgtaaggatgatgcccaaaagtggaaggttactaacactaatggttatgttacctttacatctgctcttggtaattatatgattgatattgccaatggagaagatagaaacggagccaatgttcaaatttatgatgcctacggtggtgatgctcaacaattcattatcta

SEQ ID NO: 26780 - DNA, 273 bp, Neocallimastix californiae
  RicinB_lectin_2
agttaaacttaatgatggatggtattacattaaaaatactggatctggtaaatacctcaatgttaaggatggtaaagctgcttctactcaaaatgttgtaattggttcttctaaacaaaaatggaagcttaccaacaacagtgacaataccgttactttacttagtgaagttggagatttcatgttagatgttaatggtggcagtagtgataatggtgccaatattcaaatttacaatgcttatggtggagatgctcaaaaattcgtcattag

SEQ ID NO: 26781 - DNA, 264 bp, Neocallimastix californiae
  RicinB_lectin_2
taatgatggatggtattacataaaaaacccaagttcaggaaaatatcttgttgttaaagataaaaagggtgctgcttctcaaaatgttgaaattagttcttctaagcaaaaatggaagcttaccaacaataatgataataccgttaccttacttagtgaagttggagatttcatgttagatgttaatggaggtagtgacaagaataatgctaatattcaaatttatcatgcttatggtggagatgctcaaaaattcatcattaa

SEQ ID NO: 26782 - DNA, 312 bp, Neocallimastix californiae
  RicinB_lectin_2
acaaaaatggaagcttaccaacaatgatgacaatactgttactttacttagtgaagttggagatttcatgttagatattgacagaggtcttgaagaaaatggtgctaatattcaaatctaccatgcttacggtggagatgcccaaagatttatcattaaagaaactggtaagtctaaggtttatgtcatcagttctaagattactaatggttacaaggttcttgatgttgaaaatcaagcaactgctgatggtagtaatgtttgtcaatgggaaaatggtgaaagaagtaatcaaacttggacttttgaatc

SEQ ID NO: 26783 - DNA, 312 bp, Neocallimastix californiae
  RicinB_lectin_2
tcaaaagtggaaacttgaaaatgttggaaacggttacgtaactttagttagtatgtatggtaactacatgttagatattgctaatggagaagataaagatggttctaaccttcaaatatactctgcttatggtggtgatgctcaacaatttataattttgaagactcctcagaataatgtatatgcaattggtactaaggctagtgaaggtactaaagtacttgatattgaaggtggaagaacatccgaaggttctaatgttttacaatggactaatggcggaaagagtaatcaaacttggacttttgaatc

SEQ ID NO: 26784 - DNA, 264 bp, Neocallimastix californiae
  RicinB_lectin_2
tggttggtactatattaagaacactggctctaacaagtatctccaaactgttggttccactgctaattcaaatgtagaaattagttcattcactggttctgctgcacaaaaatggaaggtaactaagaatagtgaaggatacattacattacttaatggtgttggtgatttcaatttagatgtagccaacggtaagaatgaaaatggtgtaaatattttaatttatatcgcttatggtggtgaagctcaacaatttgctctctc

SEQ ID NO: 26785 - DNA, 312 bp, Neocallimastix californiae
  RicinB_lectin_2
acaaaaatggctacttactaatgttggtgatgatgaagttactttaactactgaacttggtaattatatgttagatgttaattctggtagtgaaaataatggagcaaacattcaaatctataatagtcatggaggagattctcaaagattcattattgaagaaacttatcaaagtgatgtttatgtcattggtacaaaggtaactaatggttataaggttattgatgttgaaagagaaggtaaggacgatggtagtaatgtttgtcaatgggataatggtgaaaaaccaaaccaaacttgggtattcgaatt

SEQ ID NO: 26786 - DNA, 261 bp, Neocallimastix californiae
  RicinB_lectin_2
caagattcttaatgtcaatgccaataaggttcttgatgttaacgatgcttcctattctgatggtgccaatgttattctctggagcgataatggtaactctaaccaacgttggattattcaagaacttggtgatggatatgtcactattgaaaactataacagtggtaagaaccttgatgttgaaaagtcatctacttctgatggtggtaatgtcttacaatggagtaacaatggtcaaaacaaccaacaatggaagttagt

SEQ ID NO: 26787 - DNA, 312 bp, Neocallimastix californiae
  RicinB_lectin_2
acaaaaatggaaggttacaaaaaataatgatggttccgttgtaataatttctgaatttggtaacttcgctttagatattgcaaatggttctggagataatggagctaatgttcaaatttacactactcatggtggtgatgctcagaagtttattattagagaaacttctaactctggtatattcgttattgatactattgctagtggtggttctaaagctttagatattgaaggtggtcgtagtgctgatggtactaacatttgtcaatgggatgattctgcaaagagtaatcaaacttggacttttgaagc

SEQ ID NO: 26788 - DNA, 270 bp, Neocallimastix californiae
  RicinB_lectin_2
tggaggttacagaatcttaaatgtcaatgccgataaagcccttgatgttgaaagagattcaactcaaaatggtggtaatattatcatttggcctgataccggtaacctcaatcaacgttggactattgaagatgctggaaatggttatgttgaaatcgttaatcttagtagtggtaaagctcttgacgttgaaaatgaatccactgctgatggtgccaatgtttgtcaatgggatgctcatggtagtcaaaaccaacaatggaaattagt

SEQ ID NO: 26789 - DNA, 261 bp, Neocallimastix californiae
  RicinB_lectin_2
agatggttggtatactattaaaaatactggttctggaagatatcttcaagttagtcaaggtagagctagtgatagttccaatattgttattggttctaatgctcaaaaatggaaacttgaaaatgttgatgaggaatatattactttattaactatgtatggaaactatatgattgatgtagctaatggtgaagataagaatggatcgaatattcaaatttatagtgcttatggtggtgatgctcaacaatttactcttat

SEQ ID NO: 26790 - DNA, 288 bp, Neocallimastix californiae
  RicinB_lectin_2
atggaagattgttgaagatggaggttacagtttcaccaatgttaattctaataaagtacttgatatgaatggagcctctcttgaagatggaggtaatgctattatttggccagatattgctggtccaaatcaacgttggtctattgaaaatgctggagatggttatgtctatattattaactttaatagtaataaagtccttgatgttgccaatgtttcaaaggaagaaggaggaaatgttcatcaatggaccatcacaaatggtgccaatcaacaatggcaattaat

SEQ ID NO: 26791 - DNA, 273 bp, Neocallimastix californiae
  RicinB_lectin_2
tggtgacagatacaagatcattaatcgttacactaacagagttttagctgttgaaaacgattccaccgctaataatgccaatgttctccaatggggtgacaatggaagttccggtcaacaatgggttgttgctaaggaaggtgatcaatacagaattactagctatactaccaacaaggccttagatgtcagtggaagatcaactgccgatggtggtaatgttattatttatgatgataaggctcaaggtaatcaacgttggaagtttattga

SEQ ID NO: 26792 - DNA, 267 bp, Neocallimastix californiae
  RicinB_lectin_2
agatggttggtacttcatcaagaatccaagatctggtttatatcttcaagttagtaatgattatgctagagcttctgccaatattgaaattggtactggaacaaaatctgatggtcaaaaatggaaagttacaaacgttggtgatggatacattactttaactactgctcttggtgacttcaatattgatattgccaatggtgatgataaaaacggagccaatgttcaaatctatgatgcctacggtggaaatgctcaacaatttgt

SEQ ID NO: 26793 - DNA, 264 bp, Neocallimastix californiae
  RicinB_lectin_2
taaggatggttggtatactatcaagaacacaggttccggtaaatatcttaatgtagattatggtagagctagtgctggagctaatgttgttattggttctgatgctcaaaagtggaaggttgaaaacaacagtgaaggttatgttactttagtatctatgtatggtaattacatgttagatattgccatgggtgaagataagaatggagcaaacattcaaatttacgatgcttatggtggagacgcccaacaattctctcttat

SEQ ID NO: 26794 - DNA, 261 bp, Neocallimastix californiae
  RicinB_lectin_2
agatggatggtatacaattaaaaatactggatctggtaaatatcttcaagttcaaaatggtagagcttcagatagtgcaaatgtagttataggttccaatgctcaaaaatggaaaattcaaaatattggagatggctatgttactattctttccatgtatggtgattatatgttagatgttgccaatggtgaagatgtagatggtgctaatgttcaaatttattcttcctatggtggtgatccacaacaatttattattgc

SEQ ID NO: 26795 - DNA, 273 bp, Neocallimastix californiae
  RicinB_lectin_2
aggcaatggttataagattatgaatgttaatgctaataaggctcttgatgtcagtgaaaattcagtgaaggatggtggtgatgttattatctggagtgataatggccataataaccaacgttggaatatccaagatgttggtaatggttatgttactattaaaaacgtcaacagtggtaagaaccttgatgttgagaaggaatctacctctgatggagctgatgttatacaatggggtaataatggtaacagtaaccaacaatggaaattagt

SEQ ID NO: 26796 - DNA, 279 bp, Neocallimastix californiae
  RicinB_lectin_2
cactactggtggtaaatacaagattattaaccgtaacagtggtaaagctttaggtattgatggtgattctacttcaaatggtgccaatgttattcaatggtctgataatggaaagactagtcaacaatgggtcatcacagatgaaggcaatggttataagattatgaatgttaatgctaataaggctcttgatgtcaatgataattcaatgaaggatggtggtaatgttattatttggaatgataatggtaataataaccaacgttggaatattcaaga

SEQ ID NO: 26797 - DNA, 258 bp, Neocallimastix californiae
  RicinB_lectin_2
agaagagtatcgcattgcaattcaactcagtggaaaatatataacagctgccaataatggaaatgttcaccaatgggaaaatttaaatgataattctcaagtttggtattttgaagatgcaggtaatggaaaatttgctattctttcaggaaaaaatagaaaattagccatgacggttgaaaatggtgattctaaaaatggtaataatattcttcttactgaatataaaaatactgctgctcaacattttattctcca

SEQ ID NO: 26798 - DNA, 273 bp, Neocallimastix californiae
  RicinB_lectin_2
agatggatggtattttattaaaaattcaagttctggaaaataccttcaggtaagtaatgaaaattctagagctgcttcaaatattgaaattggttctagtcgtaaatctgatggtcaaaaatggaagctaactaatgttggtgatggttatgttactctaacttcagctctcggtaattttaatgttgatgttgctaatggagaagataaaaacggtgctaatattcaaatttatgatgcttatggtggtaatgctcaacaatttattattat

SEQ ID NO: 26799 - DNA, 246 bp, Neocallimastix californiae
  RicinB_lectin_2
caacgccttaactgtagaaaatggtaataataaagatggtaataaaattattttatcacaatatcgtaaaacatccgctcaacatttcattcttcacaaaactgatggtaattatgatacctactatattactgctgaatgttctggtaacgctgctttagatgtttatgatcaaagctctgataatggagcaaaaattgatcagtggaattattggggtggagataatcaaagattttatattat

SEQ ID NO: 26800 - DNA, 270 bp, Neocallimastix californiae
  RicinB_lectin_2
agatggttggtattttattaaaaacccagaatcaggaaagtatcttcaagtatcagctgcaaaagatgcaagctccgctggtaatgttgtaatttcaactggaaccaaagacaatggtcaaaagtggaaacttaccaatgttagcaatggtttagttactttaacatcatcacttggtaattataatattgatgttgctaatggaaaagattctaatggtaataatattatattatataattcttatggtggtgaaccgcaacaattcat

SEQ ID NO: 26801 - DNA, 279 bp, Neocallimastix californiae
  RicinB_lectin_2
tgataccgttgatgaaggttggtacttcataaagaacccatctactggtaagtatcttactgcttctggtaactcagttccattcaatgtaattattagtaccggataccaagaagacaatcaaaagtggaaggttactaacgctggtaatggttacattactttaactagtggtcttggtgactatatgttagatgttgccaatggttctgctaataatgatgctaacattcaagtttatagtgcctatggaggagatgctcaacaattcaaacttgt

SEQ ID NO: 26802 - DNA, 270 bp, Neocallimastix californiae
  RicinB_lectin_2
tgatggatggtattttataaaaaatccaagttctggtaaataccttcaagttgctaacgaaaatggtaaaaatgttgccaatattgaaatcggtacaggcagacaatctgatggtcaaaaatggaaacttactaatgttggtaatggttatgttactttaacttcagcccttggtgaattcaacattgatattgccaatggagaaaacaaagatggaactaatgtacaaatttatgaagcctatggtggtgaagctcaacaattcgttat

SEQ ID NO: 26803 - DNA, 309 bp, Neocallimastix californiae
  RicinB_lectin_2
aaaatggaaaattactaatgtaggtaatggtttagttactttcaccactgcacttggtgattatatgattgatgttgaagcaggttcaggtaagaatgatgccaatattcaattatataatgcttatggtggtgatgctcaacaatttatgattttaaagacaactgaaaaagatgtttatactattggtactaaagttagttactttgataaagctcttgatatagctcaagctaaaactgctgatggtacaaatgtcgttcaatggactaatgaaatgaaagctaatcaaagttggacctttgaaag

SEQ ID NO: 26804 - DNA, 312 bp, Neocallimastix californiae
  RicinB_lectin_2
tcaaaaatggaagcttactaacaccgacgatggatatattactttagttagtgaactcggaaattacatgatcgatgtagcaaatggtagtggtgaaaataacgctaatgttcaaatctatgatgcttatggaggagatgctcaaaaattcgttcttttaaagacttctcaatccaacacttacgttattgctactaaagcaagtaatggatacagagttcttgatattgaaaagaatggtactgctgaaggtagtaatgttttacaatgggataaccaagaaaaggctaatcaattttgggttttcgaaaa

SEQ ID NO: 26805 - DNA, 261 bp, Neocallimastix californiae
  RicinB_lectin_2
ggatggttggtataccattaaaaacccaaattctaacaaatatcttcaagttagttatggtagaggtggtgatgccgttaatgttgttatcggttccaacccacaaaaatggaaacttgaaaatgttggtgatggttatgttactttacttactatgtatggtgactacatgttagatgtagctgctggtgatagtaaagatggtgctaacattcaaatttattctgcttatggtggtgatgctcaacaatttgctattat

SEQ ID NO: 26806 - DNA, 264 bp, Neocallimastix californiae
  RicinB_lectin_2
tgatggatggtattatattaaaaatccagcttctggtaaatatcttgctgttagaaatggtattggtgctgatgctcaaaatgttgaaattagttccacaaaacaaaaatggaagatttcaaataatgatgatggtactgttttaattattagtgaacttggagattatgctttagatgttagtgctggtagtagtaataatggagctaatattcaaatttattccgcctatggtggtgaagctcaaagatttattattagaga

SEQ ID NO: 26807 - DNA, 264 bp, Neocallimastix californiae
  RicinB_lectin_2
tcttaaagatggttggtatactattaaaaacactggatccggtttatatcttggtgttaacaatggaagagctagtgacagtgccaatgttgttattgattctgatgctcaaaaatggaaacttgaaaatgttggtaatggttacatgactttaacctccatgtacggtgattacaaaattgatattgctggtgctgatgattctaatggttctaatgttcaaatttacactactcacggtgaagataatcaacaatttattgt

SEQ ID NO: 26808 - DNA, 291 bp, Neocallimastix californiae
  RicinB_lectin_2
ttggaagatttctgaagatggaggttacagaattctcaatgttaatgccaataaagtacttgatatgaatgcagaatctaccgctgatggaggtaatgctattatatggccagatactggaggtatgaatcaacgttgggttattgaaagtgctggaggtaattatgtttatattataaactctcacagtggaaaagctcttgatgttgataagagttcaaatgatgatggaggtaatattattcaatggagtcttagtaataatagttcaaaccaacaatggcaattaat

SEQ ID NO: 26809 - DNA, 309 bp, Neocallimastix californiae
  RicinB_lectin_2
aaagtggaagcttactaatactaatgatggttacattaccttaactagtagtgttggaaactatatgttagatgttgctggtggtgaagataaaaatggagttaatcttcaaatttacagtgcttatagtggagatgctcaaaaattcgtcatattaaagacttctaataataaggtatacactattggatccaaggttagtaatggcggtaaagttattgatgttgaaaaaagaggtacgactgatggaagtaatgttattcaatacgctcttaatggtgcttctaatcaaacttggacatttgaatc

SEQ ID NO: 26810 - DNA, 261 bp, Neocallimastix californiae
  RicinB_lectin_2
tggttggtattacattatgaatactggttctcaaagatatttaactgttaaggatgctaaagctgccaattcacaaaatattgaagtgaattccaaaaaacaaaaatggaaggttatgaatactagtgaaggtacagttaccatggaaagtgaacttggtaattatatgattgatgttaatggtggtagtgaagccaatggtgctaatattcaaatttatgaatcttatggaggagatgcccaacaattctatattagaga

SEQ ID NO: 26811 - DNA, 276 bp, Neocallimastix californiae
  RicinB_lectin_2
ttctggtggtaaatacaaacttattaatcgtaacagtggaaaagcattaggtgttgatggtgattctacttcaaatgctgctaatgttcaccaatggactgataatggtaaaactagtcaacaatggattattactgatgaaggttatggttataagatcatgaatgttaatgctaataaggcacttgatgttaatgaaaattctacaaagaatggtggtaatgttattatttggtctgataatggaaatcttaatcaacgttggtatattgaaga

SEQ ID NO: 26812 - DNA, 270 bp, Anaeromyces robustus; identical to SEQ ID NO: 26802
  RicinB_lectin_2

SEQ ID NO: 26813 - DNA, 279 bp, Anaeromyces robustus; identical to SEQ ID NO: 26801
  RicinB_lectin_2

SEQ ID NO: 26814 - DNA, 261 bp, Anaeromyces robustus; identical to SEQ ID NO: 26805
  RicinB_lectin_2

SEQ ID NO: 26815 - DNA, 312 bp, Anaeromyces robustus; identical to SEQ ID NO: 26804
  RicinB_lectin_2

SEQ ID NO: 26816 - DNA, 309 bp, Anaeromyces robustus; identical to SEQ ID NO: 26803
  RicinB_lectin_2

SEQ ID NO: 26817 - DNA, 264 bp, Anaeromyces robustus; identical to SEQ ID NO: 26807
  RicinB_lectin_2

SEQ ID NO: 26818 - DNA, 264 bp, Anaeromyces robustus; identical to SEQ ID NO: 26806
  RicinB_lectin_2

SEQ ID NO: 26819 - DNA, 291 bp, Anaeromyces robustus; identical to SEQ ID NO: 26808
  RicinB_lectin_2

SEQ ID NO: 26820 - DNA, 276 bp, Anaeromyces robustus; identical to SEQ ID NO: 26811
  RicinB_lectin_2

SEQ ID NO: 26821 - DNA, 315 bp, Anaeromyces robustus
  RicinB_lectin_2
acaaaaatggaaagttactaatatggatgataatactattacattacttagtgaacttggagattatatgttagatgttagtagtggtagtagtgaaaatggagctaatattcaaatttatgatgcttatgctggagatgctcaaaaatttgttcttagagaaacttctaaagaaggagtttatgttattagtaccaaggttagtaatggttataaagttcttgatgtagaaagagaaggtaaaagtgatggtagtaatgtttgtcaatgggataatggaggtgaaaaagctcatcaaacttgggtatttgaatc

SEQ ID NO: 26822 - DNA, 273 bp, Anaeromyces robustus
  RicinB_lectin_2
agatggaggttacagaattcttaatgttaatgccaataaagtacttgatatggataatgaatcattaaaagatggaggtaatgcccttatatggccagatactggagcattaaatcaacgttggcttattgaagatgctggtaatggatatgttaatattataaactataatagtgaaaaagctcttgatgttgaaaagaattcaaatgctgatggaggtaatgtcattcaatggacacttactaatagtgcaaaccaacaatggcaattaat

SEQ ID NO: 26823 - DNA, 225 bp, Anaeromyces robustus
  RicinB_lectin_2
tgctagttccggttatcgtctttacattactaaaggtgataattctggtcctatcgaagaatccgttgaagttccaattatttttattccagaaggtacttacagaattattaaccgtaacagtggaaaagctttatcagttgctaatgattccaagaataatgctgctaatgttcatcaatggacctacagtaataaagctagtcaacaatggaagattactga

SEQ ID NO: 26824 - DNA, 255 bp, Anaeromyces robustus
  RicinB_lectin_2
tggttggtacactattaaaaacgttggttctggaaaataccttcaagtcagttacggaagtgcttctgacagtgccaatgttgttattggttctaatgctcaaaaatggaaacttgaacatgttgatgatgattacttcactttactttccatgtatggtaattacatgattgatattgctatgggtgaagataaggatggttctaatgttcaaatatattctgcctatggtggtgaagctcaacaatttagtgt

SEQ ID NO: 26825 - DNA, 252 bp, Anaeromyces robustus
  RicinB_lectin_2
tggttggtacactattaaaaaccctatttctggaaaatatcttcaaattcgttatggaagtgatgcagatacttccaatgttgttattggtactaatcctcaaaaatggaaacttgaacatgttgatgatgattatttcacattagcttctatgtatggtgattatatgttagatgttaatagaggtgaaaataaagatggtgcaaatattcaagtttattctgcttatggtggtgatgctcaacaatttag

SEQ ID NO: 26826 - DNA, 255 bp, Anaeromyces robustus
  RicinB_lectin_2
cggaaaagattataatatagtatcagtacttagtggaaaatatgtaacagctgccagtaatggtaatgtacaacaatatgaaaaacttaataatgacaaatctcaaatatggcgtttagaaagtgcaggtaatggaagatttgctatacttcaaggtaatatggctatgactgtagaaaatggtaataacaataatggaaataatatttatatgtcagaatacagaaaaacaactgctcaacacttttcaattaa

SEQ ID NO: 26827 - DNA, 273 bp, Anaeromyces robustus
  RicinB_lectin_2
aggtaatggttataagatcatgaatgtaaatgctaaaaaagctcttgatatttatggaagttctgtagaaaataatggtaatgctattattatgaccgataatggaaattcaagtcaacgttggactgttaaagatcttggtgatggatattacattattcaaaacgttaatagtggattattacttgatgttgaaagaaaatctacagctgatggtggtaatgtattacaatggccaaataatggtaatagtaatcaacaatggaaattagt

SEQ ID NO: 26828 - DNA, 282 bp, Anaeromyces robustus
  RicinB_lectin_2
tcctactaatggaaatacttttaaaattattaatcgtttaagtggtaaagcattatcagttaatggtgattctacagctaatgaagccaatgttattcaatggaccgataatggtaaaacaagtcaacaatggattattacccaagaatcaaatggatataagattatcaatgttaatgctaataaagctcttgatgtttataaaaattcaagagataatggtggaaatgttattatttggtatgataatggtgcatctaatcaacgttggaatattcaaga

SEQ ID NO: 26829 - DNA, 261 bp, Anaeromyces robustus
  RicinB_lectin_2
aaatggttggtacaccattaaaaatactggatcaggtaaatatcttcaagttagttatggtagagctggtgatggtgttaatgtagttattggttctaacgctcaaaaatggaaacttgaaaatgttagtgatggttatgttactttacttactatgtatggggattatatgttagatgttgcagcaggtgaagataaggatggtgctaatcttcaaatttattcttcttatggtggtgataatcaacaattttcaatttt

SEQ ID NO: 26830 - DNA, 309 bp, Piromyces finnis
  RicinB_lectin_2
tcaaaaatggaaacttactaatgttgataatggatatgtcaccttagttagtatgtacggaaattacatgttagatgttgccaatggtgattccaagaatggagctaaccttcaaatctacacttctcatggtggtgatgctcaacaatttatcttcttaaatacctcaaagaataatgtttacgttattggtactaaggccagtagtggtactaaggttcttgatattgaaagtgaaggtactgccgatggaagtaacattttacaatgggaaaatggtgaaaagagcaaccaaacttgggttattga

SEQ ID NO: 26831 - DNA, 309 bp, Piromyces finnis; identical to SEQ ID NO: 26755
  RicinB_lectin_2

SEQ ID NO: 26832 - DNA, 312 bp, Piromyces finnis
  RicinB_lectin_2
aaaatggaaacttgaaaatgttggagaaggttatgttaccttactttctatgtatggtgattttatgattgatgtagctatgggtgaagataaggatggttctaacattcaaatttacactgcttatggtcatgatgctcaacaatttactattataaaaacaacaaaggaaaacgtttatataattggtaccagagtctctgaaggtggtaaagtattagatgttgaaagagaaggcactgcagatggtagtaatgtcgttcaatggactggtggtggtgaaaagggtaatcaaacttggcttttcgagtc

SEQ ID NO: 26833 - DNA, 240 bp, Piromyces finnis
  RicinB_lectin_2
tcttaccgtagaaaacggtaacaataaaaacggtaataaaatgattttatctcaatatcaaaataatgcagctcaacgttttattttccataaaaccgatgatgtatatgataattattatatcactgctgaatgttctggtaatgctgctttagatgtttatgatcaaagttatgataatggtgctaatattgatcaatgggattattggggtggagataatcaaaaattttatgttat

SEQ ID NO: 26834 - DNA, 243 bp, Piromyces finnis; identical to SEQ ID NO: 26699
  RicinB_lectin_2

SEQ ID NO: 26835 - DNA, 267 bp, Piromyces finnis
  RicinB_lectin_2
aaaggatggtaattattatatcaagagtgtatcttcaaacaagtatcttgttgtcaaggatggtataggagctaatgctcaaaatgttgaaattggttcaaccaaacaaaaatggaagatcagtaataatagtgatggtacagtttatatcattagtgaattaggtgattatgctttagatgttgacagaggtctcggtgataatggtgctaatatccaaatttatccacttcacggaggcgaagctcaaaagtttattattaggga

SEQ ID NO: 26836 - DNA, 270 bp, Piromyces finnis
  RicinB_lectin_2
agatggttggtatttcattaaaaatccttcaactggaaagtatcttcaagttagagatgaagaaggaaaaaatgttgccaatattgaaattggctcaggacgtaaatctgatggacaaaaatggaaattaactaatgttggtgatggctatgtcacattaacctctgctcttggtgaatataatattgatattgctaatggtgaagataaaaatggagctaatgttcaaatctatgaagcatatggtggtgatgctcaacaatttgttat

SEQ ID NO: 26837 - DNA, 297 bp, Piromyces finnis
  RicinB_lectin_2
tcaacaatgggttattagtgaagaaggtgattactttagtttaataaatgttaatgccaagaaagctcttgatgtaaatgaaaattcaactgaaaatggtggtaatgtcattatctggccagatactggagcccttaaccaacgttggagtattcaaagtactggtgatggttattacaccattacaaatgccaacagtggaaagaatctcgatgttgaaaagggatctatgtctgatggtggtaatgttttacaatggggtaataatggtggtgctaatcaacaatggaagttagt

SEQ ID NO: 26838 - DNA, 297 bp, Piromyces finnis; identical to SEQ ID NO: 26837
  RicinB_lectin_2

SEQ ID NO: 26839 - DNA, 261 bp, Piromyces finnis
  RicinB_lectin_2
aaaaattgtcaacgttaatgcaaataaatgtttagatgttagcggaagatcaaaggataatggaggtaatattgttatttaccatgataatggatatatgaatcaacgttggactttccaagatgcaggtaatggttatattactattagaagttcacatagtggaaaacttattgatgttgataatagagcaacaacggatggtgcaaatgtacttcaatgggaaccaaatggtctagacaatcaacaatggaaacttgt

SEQ ID NO: 26840 - DNA, 309 bp, Piromyces finnis
  RicinB_lectin_2
aaaatggaaacttactaatatgagtggtggttatgttactttagtcagtagtcttggtgaatatatgttagatattgctggtggtgatgatggaaatggtactaatgttcaaatttacagtgcatacgctggtgaagctcaacaatttgttattttaaagacatcaaaggataaggtttacactattggtactagagtttctaatggttacagagttcttgatgttgaaaagaatggtactactgatggtagcaatgttttacaatgggataactcagaaaagagtaatcaaacctggacttttgaatc

SEQ ID NO: 26841 - DNA, 279 bp, Piromyces finnis
  RicinB_lectin_2
cgtcaagattgaagatggttggtattacattaagaacccagcttcaggtaaatacctccaagttgctaataaccaagctaaggctacagccaatattgaaattggatcatctagtcaagatgatggacaaaagtggttacttactaatgttggtgaaggttatgttaccttaaagagtgctcttggcgatttcatgattgatgttagtagtggtgaagacaagaatggagccaatattcaaatctacactgcctatggtcacgatgctcaacaattcat

SEQ ID NO: 26842 - DNA, 279 bp, Piromyces finnis; identical to SEQ ID NO: 26841
  RicinB_lectin_2

SEQ ID NO: 26843 - DNA, 279 bp, Piromyces finnis; identical to SEQ ID NO: 26841
  RicinB_lectin_2

SEQ ID NO: 26844 - DNA, 270 bp, Piromyces finnis
  RicinB_lectin_2
tggatggtattacattaagaatactggatctaacaaatatcttcaagtaaagggtaataatggtgtagccaatactaatgtcgaaatcggaacctttgcaggtgcttctggacaaaaatggaaggttacacaaacaagtgatggttacattactttaactagtgctcttggaaactttatgttagatgtagctaatgctaaagatactgatggtaataatattcttatttatattggttacagtggtgatgcccaaaagttctctcttaa

SEQ ID NO: 26845 - DNA, 279 bp, Piromyces finnis; identical to SEQ ID NO: 26841
  RicinB_lectin_2

SEQ ID NO: 26846 - DNA, 270 bp, Piromyces finnis; identical to SEQ ID NO: 26844
  RicinB_lectin_2

SEQ ID NO: 26847 - DNA, 264 bp, Piromyces finnis
  RicinB_lectin_2
agatggatggtattacattaaaaacactggttccaacaagtatctttcagttaagggtgctgttggtgctaacggtcaaaatgttcaaattagttccactaaacaaaagtggaagatttacaataacaatgatggtactgttctcttaattagtgaatttggtgattatgctttagatgtcagtaacggttctggtgaaaatggtgccaacattcaaatttactctattcatggtggtgatgctcaaaagtttatcattagaga

SEQ ID NO: 26848 - DNA, 243 bp, Piromyces finnis; identical to SEQ ID NO: 26699
  RicinB_lectin_2

SEQ ID NO: 26849 - DNA, 351 bp, Neocallimastix californiae
  SCP-like
tgaaggttttaaagcttccaaaatctttgaaaaacttaaggctactttagaagctactccagcttcaataagaagacataaaaccaaaactataaatgctgttttccaatttgatgttagaaatgataaacgcgaaagacaaacatggtatatagattataagaatggacaaggtgatattggtattggaaaaccaccacaatcaagagccgatttaatagtagcagcaagagatgaagttataatagatttagcctcaagaaaaattactggtcaaaaggcatatatgcaaagtaaaattaagttaaagggtaatcacgctttagctatgaaattagatagtatccttgc

SEQ ID NO: 26850 - DNA, 351 bp, Anaeromyces robustus
  SCP-like
tgaaggttttaaggcttcaaagatttttgaaaaacttaaagctactttagaagctactccatcacctgaaagaagacataaaactgatactattaacgctgtcttccaatttgatgttagaaatgataaacgtgaaagtcaaacttggtatatagattataaaaatggtcaaggtgaaataggtattggtaagccaccacaatctaaaccagatttaatagtagcagctagagatgatgttataatagatttagcttcaaggaagatcaccggtcaaaaggcatatatgcaaagtaaaattaagttaaagggtaatcacgctttagccatgaaattagatagtattcttgc

SEQ ID NO: 26851 - DNA, 351 bp, Piromyces finnis
  SCP-like
tgaaggtttcaaggcctctaagattttcgaaaaacttaaggctaccttagaagccacttcaggtccagaaagaagactcaaaactaaacaaataaatgctgtcttccaatttgacgtacgaaatgataaacgcgaaagtcaaacatggtatatagattataagaatggtcaaggtgatataggtattggtaaaccaactcactcaaaaccagatttaataatagctgccagagatgaagttataatagatttagcttcaaggaaaattaccggtcaaaaggcatacatgcaaagtaaaattaagttaaagggtaaccatgctttagccatgaaattagatagtattcttgc

SEQ ID NO: 26852 - DNA, 291 bp, Neocallimastix californiae
  SCP2
agcttcaataagaagacataaaaccaaaactataaatgctgttttccaatttgatgttagaaatgataaacgcgaaagacaaacatggtatatagattataagaatggacaaggtgatattggtattggaaaaccaccacaatcaagagccgatttaatagtagcagcaagagatgaagttataatagatttagcctcaagaaaaattactggtcaaaaggcatatatgcaaagtaaaattaagttaaagggtaatcacgctttagctatgaaattagatagtatccttgc

SEQ ID NO: 26853 - DNA, 312 bp, Anaeromyces robustus
  SCP2
agctactttagaagctactccatcacctgaaagaagacataaaactgatactattaacgctgtcttccaatttgatgttagaaatgataaacgtgaaagtcaaacttggtatatagattataaaaatggtcaaggtgaaataggtattggtaagccaccacaatctaaaccagatttaatagtagcagctagagatgatgttataatagatttagcttcaaggaagatcaccggtcaaaaggcatatatgcaaagtaaaattaagttaaagggtaatcacgctttagccatgaaattagatagtattcttgc

SEQ ID NO: 26854 - DNA, 291 bp, Piromyces finnis
  SCP2
aggtccagaaagaagactcaaaactaaacaaataaatgctgtcttccaatttgacgtacgaaatgataaacgcgaaagtcaaacatggtatatagattataagaatggtcaaggtgatataggtattggtaaaccaactcactcaaaaccagatttaataatagctgccagagatgaagttataatagatttagcttcaaggaaaattaccggtcaaaaggcatacatgcaaagtaaaattaagttaaagggtaaccatgctttagccatgaaattagatagtattcttgc

SEQ ID NO: 26855 - DNA, 351 bp, Neocallimastix californiae
  SCP2_sterol-bd_dom
aggttttaaagcttccaaaatctttgaaaaacttaaggctactttagaagctactccagcttcaataagaagacataaaaccaaaactataaatgctgttttccaatttgatgttagaaatgataaacgcgaaagacaaacatggtatatagattataagaatggacaaggtgatattggtattggaaaaccaccacaatcaagagccgatttaatagtagcagcaagagatgaagttataatagatttagcctcaagaaaaattactggtcaaaaggcatatatgcaaagtaaaattaagttaaagggtaatcacgctttagctatgaaattagatagtatccttgctgt

SEQ ID NO: 26856 - DNA, 351 bp, Anaeromyces robustus
  SCP2_sterol-bd_dom
aggttttaaggcttcaaagatttttgaaaaacttaaagctactttagaagctactccatcacctgaaagaagacataaaactgatactattaacgctgtcttccaatttgatgttagaaatgataaacgtgaaagtcaaacttggtatatagattataaaaatggtcaaggtgaaataggtattggtaagccaccacaatctaaaccagatttaatagtagcagctagagatgatgttataatagatttagcttcaaggaagatcaccggtcaaaaggcatatatgcaaagtaaaattaagttaaagggtaatcacgctttagccatgaaattagatagtattcttgctgt

SEQ ID NO: 26857 - DNA, 351 bp, Piromyces finnis
  SCP2_sterol-bd_dom
aggtttcaaggcctctaagattttcgaaaaacttaaggctaccttagaagccacttcaggtccagaaagaagactcaaaactaaacaaataaatgctgtcttccaatttgacgtacgaaatgataaacgcgaaagtcaaacatggtatatagattataagaatggtcaaggtgatataggtattggtaaaccaactcactcaaaaccagatttaataatagctgccagagatgaagttataatagatttagcttcaaggaaaattaccggtcaaaaggcatacatgcaaagtaaaattaagttaaagggtaaccatgctttagccatgaaattagatagtattcttgcagt

SEQ ID NO: 26858 - DNA, 27 bp, Neocallimastix californiae
  SDRFAMILY
tagaattattaatattacttctgcggc

SEQ ID NO: 26859 - DNA, 36 bp, Neocallimastix californiae; identical to SEQ ID NO: 23393
  SDRFAMILY

SEQ ID NO: 26860 - DNA, 60 bp, Neocallimastix californiae; identical to SEQ ID NO: 23394
  SDRFAMILY

SEQ ID NO: 26861 - DNA, 36 bp, Neocallimastix californiae; identical to SEQ ID NO: 23393
  SDRFAMILY

SEQ ID NO: 26862 - DNA, 60 bp, Neocallimastix californiae; identical to SEQ ID NO: 23397
  SDRFAMILY

SEQ ID NO: 26863 - DNA, 27 bp, Neocallimastix californiae
  SDRFAMILY
tagaattattaatattacctctgctgc

SEQ ID NO: 26864 - DNA, 36 bp, Anaeromyces robustus; identical to SEQ ID NO: 23403
  SDRFAMILY

SEQ ID NO: 26865 - DNA, 60 bp, Anaeromyces robustus; identical to SEQ ID NO: 23404
  SDRFAMILY

SEQ ID NO: 26866 - DNA, 27 bp, Anaeromyces robustus
  SDRFAMILY
tagaattattaatattacttctgctgc

SEQ ID NO: 26867 - DNA, 36 bp, Piromyces finnis; identical to SEQ ID NO: 23409
  SDRFAMILY

SEQ ID NO: 26868 - DNA, 60 bp, Piromyces finnis; identical to SEQ ID NO: 23408
  SDRFAMILY

SEQ ID NO: 26869 - DNA, 27 bp, Piromyces finnis
  SDRFAMILY
tagaattattaatattacatctgctgc

SEQ ID NO: 26870 - DNA, 192 bp, Neocallimastix californiae; identical to SEQ ID NO: 23416
  SERINE PROTEASE INHIBITOR, SERPIN

SEQ ID NO: 26871 - DNA, 790 bp, Neocallimastix californiae; identical to SEQ ID NO: 14241
  SERINE PROTEASE INHIBITOR, SERPIN

SEQ ID NO: 26872 - DNA, 1056 bp, Neocallimastix californiae; identical to SEQ ID NO: 14242
  SERINE PROTEASE INHIBITOR, SERPIN

SEQ ID NO: 26873 - DNA, 1077 bp, Anaeromyces robustus; identical to SEQ ID NO: 14243
  SERINE PROTEASE INHIBITOR, SERPIN

SEQ ID NO: 26874 - DNA, 1068 bp, Anaeromyces robustus; identical to SEQ ID NO: 14244
  SERINE PROTEASE INHIBITOR, SERPIN

SEQ ID NO: 26875 - DNA, 1101 bp, Anaeromyces robustus
  SERINE PROTEASE INHIBITOR, SERPIN
ttttgatttttccttcttaaaattagaaaataataaggaaaatatgctttatagtccattatctataaaatatgctttaagaatgttattagaaggagctgaaggtaatacttatacggaattaattaaattaataggaaatgaagaacttaatccatacacaaatattgataaagtattatccttagccaatggattattcataagagatacctattatacttgtataagaccagaatatatagataccttaaaagaaaaatataatgcagatgttgtaaaagatgaatttaaaagtgcttataatgctaataaatggattgagaagaatactttaggtattattaaaaatatgcttaatgataatattgttcaaaacccagaaactataatgcttttaattaatgcccttgctatagaaatggaatggtattctccatttaattgtaattatactagtggaaccactttttatactgaggatgatgatgaaaccatagaagcaacaatgatgtctcgtgtaactggagataatagtttatcctatagtatcaatgatgatgttacagtggttaccatggatttaaataaatatggcagtactcaatttgaatttatggctatcatgccaaccaaagaaaatttaagtacttttattgaaaaggtaaccaaagaaaccattaatgaaatagataaaaatcttatatttgcttctgaaaaaccatatggcgtagatatcaccataccaaaatttaaatttagttatgatttaggattaaaaaaagatttaaaaaatttaggaataaatgatacttttgaaagaaatgaagcaaacttatcaaaaatggaaaatccagaagaattaaagcaaaatctttttgtttctgatattcttcataaagctgatattgaatttactgaaaagggagtaaaagcagctgcagtaactgttgttgtaatattacctggaagtgcaggaccatccaataaaaaaacaccattatatattacaatagatagaccatttatgtttattataagagataaaaatactaaagatatatggtttaccggtacagtatataaaccaaatttatggaa

SEQ ID NO: 26876 - DNA, 1182 bp, Anaeromyces robustus
  SERINE PROTEASE INHIBITOR, SERPIN
tgagtggtgtggtataaaggataattgtgaaagtatagtaaaggaagaagatcctataaataataatagcacagatgtttctagtaataatgattttgaatttgaattcttaaaaatggaaaatccaaaggataatatgatatatagtccattatctattgaatatgctttaaaaatgttacaagaaggagcaaatagtaatacacttgatgaaattaataaagttgtcaaaggtatggagcttcctaaatatacaaacattgataatattttatcattagcaaatggattttttataagagatatatattataaaaatgtaaaaacagaatatataaatacgttaaaagaaaaatatgacgcagatgtaatagaagatgaatttgaaaatgctgataatgttaatcaatggattaaagataaaactttagaaatcattaaaaatgtgcttaatgatgaggtagttcatgatccaagtattttaatgattttagtaaatgcacttgcaatagatatgcaatgggctaaggtgttcgatactaaagaaactcgtggtgaaatattttataaggataatggcgaaaaaataatggcaacaatgatgtttaataaagaagtaagttgcgattgtatatcatattatatagatgatgacttaacagttgtttcaatggatttaagggaatatgaaggaacacaacttgaatttatggccattatgccaaaagataatttaagtgattatgttaaaaatgtaacaaaagaacaaataaatgaaataactaaaaatcttaaatcttcattaaattcacatgatggagttaatgtaaaaataccaaaattcaattttgattataatttaaatttaaaaaaagacttaatggatttaggtattatagatgtttttgatgtaaatagagcagaccttacaaaaatatcagaaaatccaatcgatcgtttatatattgcagatgcacttcataaagcaaatattgaatttaccgaaagtggagtaaaagccgcagcagtaacagttatgattggaggatggggtgcaatgatgccaattaataaacatccaattaacgtaataatcaatcaaccatttatgtttattataagagataaaaatacaaaagatatatggtttacaggaacagtctatgaaccaaatttatggga

SEQ ID NO: 26877 - DNA, 1116 bp, Anaeromyces robustus; identical to SEQ ID NO: 14245
  SERINE PROTEASE INHIBITOR, SERPIN

SEQ ID NO: 26878 - DNA, 1488 bp, Neocallimastix californiae
  SERINE/THREONINE PROTEIN KINASE
atttttattaataatatttatcttaaatacaatagttataaatactttagtgtcttcaaattctattaatttaaatgatattgaatggttagatgttgagcattggaaccaaactgattttgatagacttcaaaaaagaggaaattatgatggtcaaattaaaaagattaatttttataaaggtgtcgacatttccagtattatttctctagaaaatagtggtattcgtttctacgacactaatggtcaacaaatagacatttttaaaatgtttgctagtgttggggttaattgtatccgtgttagaatttggaataacccaaagagtgctaatggaaaaacttatggtggtggtaataatgatcttgaagtagctagagaaataggtagtagagcagcaagtgcaggcctaccattatttgttgattttcattattctgatttctgggctgatccaggaaaacaaactattccaaaagattggaaaaactttaatcttgataaaagagtctctgaaatttatagatttactaaaggttgtttagaatggcttttacaaaatggttctcttatttcaatggttcaaattggtaatgaaactacatgctttatgtgtggtgataaaaatatgacaaatgttatgaaaatgatgagcaatggtgcaaaagctgtacgtgaaattaatagagatatattaattgctcttcattttacaaatccaaataaatcagacaatatgttatggtatgcttctcaactcgcttctgctagagttgattatgatgtttatagtacttcttactatccatattggcatggtactactgataatttaaaatgggtattaggagaaattgctaataaatatggtaagaaagttatgattgctgaatattcttacccatatactgaagttgcatatacatcagataattgtcattatggtgttgtagactctaaagcaagcggtactgtattccgttatccaattagtgttgatggtcaaattcaatgcattagagatatgtattctgttatgagaaatacaaagaatggtattggtgctttctattgggaaccagcatggattgctccaaaagcaagaaatgatatggaaagaagacaaatttgggagcaatatggttccagttgggctaccaaaactgcagctgaatatgattcaaatgctgatagaaaccttacaggaggtacatcatgggataatcaagctattttcgatcaaaatggaaaagttttaaaatctatttgggctttgggtgatggtactgctccaagtaattctgttgctgataacaacaacaataatcataacaataataataacagtaacaataataataataataacaataataataataacaataataataataacaataataataacaataacaataacaataacaataataataacaataacaataacaataacaataataataataataactgtttttctgt

SEQ ID NO: 26879 - DNA, 1060 bp, Neocallimastix californiae
  SERPIN
tttctatacaaaaatcttgtcaaaattaggtggtaaaaagaattttgcttattctccagaatcccttaatattgctcttaagttgtacgaagagttccttgtggatggagaggaaaaaaaagaaattcttaatcttattggtaataaaaattatcttgattataaaaattctttgagttctaagattgtcaatagaatatggattgatagtaaaaaaaagtatgacttctcatcagtcgtaaaaatggaaaaatatttatatgcaatagacatgtctgccgataatgctaaggagattaaagatgcctatgtatcagaagtcactgatggatttattacatctactccaactgaatttagtagtaaaactatttatgattttatgaatattttatactttaagggaaaatggaataaagatgcaaacaattttagaataaagaatattttttttccattcaaaactatcgatggaaaggaatcacacgctacatccattggctttacaaaaaagaatggttactatttgaaaaatgatgatgctattgctgttaacctttactatgaaaaagaagaaatcgaaaattatgcaggatttcagatgattgtcattttacctaatgaagataagtccatcagtgatattgatattagaccatttcttccttatgattacgaagatgaagtaactccagcaaagttaaaaaataatttcgatgaattatattttgaaatgccaaaattctctgtggagacggaatggtttataaaatcaggtacaaaagaagcctctttatttgaacttgatcactttagtggcggttcattaaatcgtaacatttataatgcatctatatcagctgaaattagtcaagtggtaaggatagaatgtgatgaaaaaggtacaactgctgctgcagttactgaagttcacggctccgctaaagcattacctaaaacccctataatatttaattttatatgtaatcgtccattcatatatgttttatatgataatgtaaatgatgatattggatttgtaggtcaagtcatgacggta

SEQ ID NO: 26880 - DNA, 1047 bp, Neocallimastix californiae
  Serpin
aatcttgtcaaaattaggtggtaaaaagaattttgcttattctccagaatcccttaatattgctcttaagttgtacgaagagttccttgtggatggagaggaaaaaaaagaaattcttaatcttattggtaataaaaattatcttgattataaaaattctttgagttctaagattgtcaatagaatatggattgatagtaaaaaaaagtatgacttctcatcagtcgtaaaaatggaaaaatatttatatgcaatagacatgtctgccgataatgctaaggagattaaagatgcctatgtatcagaagtcactgatggatttattacatctactccaactgaatttagtagtaaaactatttatgattttatgaatattttatactttaagggaaaatggaataaagatgcaaacaattttagaataaagaatattttttttccattcaaaactatcgatggaaaggaatcacacgctacatccattggctttacaaaaaagaatggttactatttgaaaaatgatgatgctattgctgttaacctttactatgaaaaagaagaaatcgaaaattatgcaggatttcagatgattgtcattttacctaatgaagataagtccatcagtgatattgatattagaccatttcttccttatgattacgaagatgaagtaactccagcaaagttaaaaaataatttcgatgaattatattttgaaatgccaaaattctctgtggagacggaatggtttataaaatcaggtacaaaagaagcctctttatttgaacttgatcactttagtggcggttcattaaatcgtaacatttataatgcatctatatcagctgaaattagtcaagtggtaaggatagaatgtgatgaaaaaggtacaactgctgctgcagttactgaagttcacggctccgctaaagcattacctaaaacccctataatatttaattttatatgtaatcgtccattcatatatgttttatatgataatgtaaatgatgatattggatttgtaggtcaagtcatgacggt

SEQ ID NO: 26881 - DNA, 33 bp, Neocallimastix californiae
  SERPIN
tatatgtaatcgtccattcatatatgttttata

SEQ ID NO: 26882 - DNA, 123 bp, Neocallimastix californiae
  Serpin
aaaattagaaaacttcaagaaaaatatgctctatagtccattttcaataaaatatgctttaaaaatgttacaagaaggagcagctaataatacttttgatgaaatcaataaattaataggaaa

SEQ ID NO: 26883 - DNA, 294 bp, Neocallimastix californiae
  Serpin
aaaattagaaaacttcaagaaaaatatgctctatagtccattttcaataaaatatgccttaaaaatgttacaagaaggagcggctaatgatacttttgatgaaatcaataaattaataggaaatactaaactttctaaacacattagtattgacgaagttttatcgttagccaatggattatttataagagatacattttataaatatataaatacaaattatataaatactttaaaggaaaactatgatgcagaagttgttaaagatgaatttaaaagtgcagcaaatgctaa

SEQ ID NO: 26884 - DNA, 832 bp, Neocallimastix californiae
  SERPIN
tgattttaatttttcatttttaaaattagaaaacttcaagaaaaatatgctctatagtccattttcaataaaatatgctttaaaaatgttacaagaaggagcagctaataatacttttgatgaaatcaataaattaataggaaatactcaactttctaaatacaccaacattgacgaagttttatctttagctaatggattatttataagagatactttttatgactatataaatacaaattatataaatactctaaaggaaaattatgatgcagaagttgttaaagatgaatttaaaaatgcagcaaatgctaataaatggattgaagataaaacatttaatatcattaaaaatatgctcactgatgaaatgattaaaaatccaactagcgtcatgcttatcatcaatgcccttgccatagatatggaatggaaagaaggattttcatttcagtatactgatggagattatttttatttagataatggtgaaaaaatgaaggcaacaacgatgtatagaaaagaatttggtacaattttaagttattatattgatgattccgtcactgtagtgacattagatttaaaaaaatatggtaatatacaatttgaatttatggccatcatgccaaagggaaatttaagtagttttatcgaaaatttcactgaagaacaaatggatcatatcaataaaaatcttaattttgccaataatgtagaagatggagtagtgttatacataccgaaattcaaatttaattatgacttaaaattaaaacaagatttaattaatttaggtataaaagatgcctttaattatagtaaatccgac

SEQ ID NO: 26885 - DNA, 810 bp, Neocallimastix californiae
  Serpin
aaaattagaaaacttcaagaaaaatatgctctatagtccattttcaataaaatatgctttaaaaatgttacaagaaggagcagctaataatacttttgatgaaatcaataaattaataggaaatactcaactttctaaatacaccaacattgacgaagttttatctttagctaatggattatttataagagatactttttatgactatataaatacaaattatataaatactctaaaggaaaattatgatgcagaagttgttaaagatgaatttaaaaatgcagcaaatgctaataaatggattgaagataaaacatttaatatcattaaaaatatgctcactgatgaaatgattaaaaatccaactagcgtcatgcttatcatcaatgcccttgccatagatatggaatggaaagaaggattttcatttcagtatactgatggagattatttttatttagataatggtgaaaaaatgaaggcaacaacgatgtatagaaaagaatttggtacaattttaagttattatattgatgattccgtcactgtagtgacattagatttaaaaaaatatggtaatatacaatttgaatttatggccatcatgccaaagggaaatttaagtagttttatcgaaaatttcactgaagaacaaatggatcatatcaataaaaatcttaattttgccaataatgtagaagatggagtagtgttatacataccgaaattcaaatttaattatgacttaaaattaaaacaagatttaattaatttaggtataaaagatgcctttaattatagtaaatccga

SEQ ID NO: 26886 - DNA, 1089 bp, Neocallimastix californiae
  SERPIN
tgattttaatttttcatttttaaaattagaaaacttcaagaaaaatatgctctatagtccattatcaataaaatatgctttaaaaatgttacaagaaggagcagctaataatacctttgatgaaatcaataaattaataggaaatactcaactttctaaatacactagtattgacaaagttttatctttagctaatggattatttataagagatactttttatgactatataaatacaaattatataaatactctaaaggaaaattatgatgcagaagttgttaaagatgaatttaaaagtgcagcaaatgctaataaatggattgaagataaaacatttaatatcattaaaaatatgctcgatgatgatatagtacaaaatccatctagcgtcatgcttatcatcaatgcccttgccatagatatgggatggtataggagtttttcatttgagaatactaatggatatgatttttatttggataatggtgagaaaatgaagaccaccatgatgtctaaaacagaaaagagcacaaatttaagttattatattgatgataacgtctccgtagtaacttcagacttaaaaaaatacgatgatatacaatttgaatttatggccattatgccaaaggaaaatttaagtagttttattgaaaatttcactgaagaacaaatggatcatatcaatcaaaatcttaatttttccactactatagaagatggagtagtattccgcataccaaaattcaaatttgattatgatttagaattaaaacaagatttgatgaagttaggtataaaagatgcctttaattatagtaaatccgacttttcaaaaatggaaggttccaccgatcccgacaaaaaactctatgtttctgaggctcttcataaagctgatattgaatttactgaagagggaataaaagctgcagccgttactgtatttggtatgaaggctacatcagctcataatccaataatccctaaacctctttatatcacctttgataaaccatttatgtttattataagggataaaaagacacaggatatttggtttaccggaaccgtctatgaacccaa

SEQ ID NO: 26887 - DNA, 1068 bp, Neocallimastix californiae
  Serpin
aaaattagaaaacttcaagaaaaatatgctctatagtccattatcaataaaatatgctttaaaaatgttacaagaaggagcagctaataatacctttgatgaaatcaataaattaataggaaatactcaactttctaaatacactagtattgacaaagttttatctttagctaatggattatttataagagatactttttatgactatataaatacaaattatataaatactctaaaggaaaattatgatgcagaagttgttaaagatgaatttaaaagtgcagcaaatgctaataaatggattgaagataaaacatttaatatcattaaaaatatgctcgatgatgatatagtacaaaatccatctagcgtcatgcttatcatcaatgcccttgccatagatatgggatggtataggagtttttcatttgagaatactaatggatatgatttttatttggataatggtgagaaaatgaagaccaccatgatgtctaaaacagaaaagagcacaaatttaagttattatattgatgataacgtctccgtagtaacttcagacttaaaaaaatacgatgatatacaatttgaatttatggccattatgccaaaggaaaatttaagtagttttattgaaaatttcactgaagaacaaatggatcatatcaatcaaaatcttaatttttccactactatagaagatggagtagtattccgcataccaaaattcaaatttgattatgatttagaattaaaacaagatttgatgaagttaggtataaaagatgcctttaattatagtaaatccgacttttcaaaaatggaaggttccaccgatcccgacaaaaaactctatgtttctgaggctcttcataaagctgatattgaatttactgaagagggaataaaagctgcagccgttactgtatttggtatgaaggctacatcagctcataatccaataatccctaaacctctttatatcacctttgataaaccatttatgtttattataagggataaaaagacacaggatatttggtttaccggaaccgtctatgaacccaa

SEQ ID NO: 26888 - DNA, 33 bp, Neocallimastix californiae
  SERPIN
cacctttgataaaccatttatgtttattataag

SEQ ID NO: 26889 - DNA, 1092 bp, Anaeromyces robustus
  SERPIN
tgattttgcctttttaaaaatggaaaataaaaagaaaaatatgttgtatagtccattatctattgaatacgccttaaaaatgttacaagaaggtgccaatggtaatacttactctgaaataaataaaatcgtaggtaatgaagaacttcctaaatacataagtcttgataaaaatttatcattagctaatggattatttataagaaacacctatagtgaatatgtcaaaccatcctatgtcagtacattaagagataaattttatgctgaagtagtagaagatgaatttaatgatgcttcaaatgttaatgaatggattgaagataaaactttaggtatcattaaagatatgcttagggatgatatagttcaaaatccaagaacttcattaattttagttaatgctcttgctatggacatgaaatgggcttatcctttcagagatgaaagtacccatggaagaacattttataaggaaaatggtcaagaaatagaagcaactacattatctactacaatatccgctaatggtgtatcctattataaagatgatgacttaactgttcttaccatggatttaaaaaaatattctgaattccaatttgaatttgtggctatcatgccaaaaaatgaaaatttaagtagttttgttgaaaaggtcacaagagaacaaattgatgaaatcgatgaaaaacttatatcatcctatgacgaacgcgatggtatttatatcagaataccaaaattcaaatttcaatatgatttagaattaaaaaaagatttaataaatttaggtgtaaatgatgctttcagtcccattaaagctgatttaaaaaagatagccgatccagaagatccagataaaaaattatatgttggtgatgcccttcataaagcagatattgaattttcagaagaaggtataaaagcagctgctgtaaccgtaattattatcatggcagctggtgcagccccaggacccagaagagaaccacaacctgtcaatgtcatcattgataaaccatttatgtttatgataagagataaaaatactaaaaatatttggtttacaggaacagtttatgaaccaaa

SEQ ID NO: 26890 - DNA, 1077 bp, Anaeromyces robustus
  Serpin
aaaaatggaaaataaaaagaaaaatatgttgtatagtccattatctattgaatacgccttaaaaatgttacaagaaggtgccaatggtaatacttactctgaaataaataaaatcgtaggtaatgaagaacttcctaaatacataagtcttgataaaaatttatcattagctaatggattatttataagaaacacctatagtgaatatgtcaaaccatcctatgtcagtacattaagagataaattttatgctgaagtagtagaagatgaatttaatgatgcttcaaatgttaatgaatggattgaagataaaactttaggtatcattaaagatatgcttagggatgatatagttcaaaatccaagaacttcattaattttagttaatgctcttgctatggacatgaaatgggcttatcctttcagagatgaaagtacccatggaagaacattttataaggaaaatggtcaagaaatagaagcaactacattatctactacaatatccgctaatggtgtatcctattataaagatgatgacttaactgttcttaccatggatttaaaaaaatattctgaattccaatttgaatttgtggctatcatgccaaaaaatgaaaatttaagtagttttgttgaaaaggtcacaagagaacaaattgatgaaatcgatgaaaaacttatatcatcctatgacgaacgcgatggtatttatatcagaataccaaaattcaaatttcaatatgatttagaattaaaaaaagatttaataaatttaggtgtaaatgatgctttcagtcccattaaagctgatttaaaaaagatagccgatccagaagatccagataaaaaattatatgttggtgatgcccttcataaagcagatattgaattttcagaagaaggtataaaagcagctgctgtaaccgtaattattatcatggcagctggtgcagccccaggacccagaagagaaccacaacctgtcaatgtcatcattgataaaccatttatgtttatgataagagataaaaatactaaaaatatttggtttacaggaacagtttatgaaccaaa

SEQ ID NO: 26891 - DNA, 33 bp, Anaeromyces robustus
  SERPIN
catcattgataaaccatttatgtttatgataag

SEQ ID NO: 26892 - DNA, 1083 bp, Anaeromyces robustus
  SERPIN
tgaatttttattcttaaaattagaaaatcataaagaaaatatgttatatagtccattatccatagaatatgctttaaatatgttacaagaaggtgccgatggaaatacttatgatgaaataaataaaattataggaaatgacgaacttcctaaatacaccaatattgaaaataatttatccttagctaatggtgtatttataaaggatacattctatgaaaatgttaaaactgattatatcaatacattaaaagaaaaatttgattccgaagttatccaagatccatttgaaagtgctgaaaatgttaatcattggattgaagataaaactttaggtattattaaaaatgttgttaatgatgatgccgttagaagtccagctatggctatgcttttaattaatgctcttgctatggatatggattggaaaatcttatttgatagttatgatactaatgaagaaaacttttatatggaaaatggtcaaagaattcaagtatctatgatgaataaaaaagaaattaaaagtgatgtcgtttcctattataaaagtaataaagtcaaagctgttactatggaatttgaagaatataatggaacagaattagaatttttagcccttatgcctaatgaagatttaagtagttttgttgaaaatattacattagaacaaattcaaaaattagatcaaaaacttattccttcctctgaaacttctaatggagttaatttaaaaataccaaaattcaaatttagttatgatttagctttaaaaaagaatttaatggatttaggaatcaatgatgcttttgatgaattaaaagctaactttacaaaaatctctgatccttattcttctggaatgaatttatttgtttccgatgctcttcataaagcagatattgaatttaccgaaaagggagtaaaagcagccgcagtaactgtagctttaacttatgctacttcatttagaccaaaaaagggtgatcctattgaaatagttatagataaaccatttatgtttattataagagataaaaataccaaagatatatggtttacaggaactgtctatgaaccaga

SEQ ID NO: 26893 - DNA, 1071 bp, Anaeromyces robustus
  Serpin
cttaaaattagaaaatcataaagaaaatatgttatatagtccattatccatagaatatgctttaaatatgttacaagaaggtgccgatggaaatacttatgatgaaataaataaaattataggaaatgacgaacttcctaaatacaccaatattgaaaataatttatccttagctaatggtgtatttataaaggatacattctatgaaaatgttaaaactgattatatcaatacattaaaagaaaaatttgattccgaagttatccaagatccatttgaaagtgctgaaaatgttaatcattggattgaagataaaactttaggtattattaaaaatgttgttaatgatgatgccgttagaagtccagctatggctatgcttttaattaatgctcttgctatggatatggattggaaaatcttatttgatagttatgatactaatgaagaaaacttttatatggaaaatggtcaaagaattcaagtatctatgatgaataaaaaagaaattaaaagtgatgtcgtttcctattataaaagtaataaagtcaaagctgttactatggaatttgaagaatataatggaacagaattagaatttttagcccttatgcctaatgaagatttaagtagttttgttgaaaatattacattagaacaaattcaaaaattagatcaaaaacttattccttcctctgaaacttctaatggagttaatttaaaaataccaaaattcaaatttagttatgatttagctttaaaaaagaatttaatggatttaggaatcaatgatgcttttgatgaattaaaagctaactttacaaaaatctctgatccttattcttctggaatgaatttatttgtttccgatgctcttcataaagcagatattgaatttaccgaaaagggagtaaaagcagccgcagtaactgtagctttaacttatgctacttcatttagaccaaaaaagggtgatcctattgaaatagttatagataaaccatttatgtttattataagagataaaaataccaaagatatatggtttacaggaactgtctatgaaccaga

SEQ ID NO: 26894 - DNA, 33 bp, Anaeromyces robustus
  SERPIN
agttatagataaaccatttatgtttattataag

SEQ ID NO: 26895 - DNA, 1089 bp, Anaeromyces robustus
  SERPIN
tgatttttccttcttaaaattagaaaataataaggaaaatatgctttatagtccattatctataaaatatgctttaagaatgttattagaaggagctgaaggtaatacttatacggaattaattaaattaataggaaatgaagaacttaatccatacacaaatattgataaagtattatccttagccaatggattattcataagagatacctattatacttgtataagaccagaatatatagataccttaaaagaaaaatataatgcagatgttgtaaaagatgaatttaaaagtgcttataatgctaataaatggattgagaagaatactttaggtattattaaaaatatgcttaatgataatattgttcaaaacccagaaactataatgcttttaattaatgcccttgctatagaaatggaatggtattctccatttaattgtaattatactagtggaaccactttttatactgaggatgatgatgaaaccatagaagcaacaatgatgtctcgtgtaactggagataatagtttatcctatagtatcaatgatgatgttacagtggttaccatggatttaaataaatatggcagtactcaatttgaatttatggctatcatgccaaccaaagaaaatttaagtacttttattgaaaaggtaaccaaagaaaccattaatgaaatagataaaaatcttatatttgcttctgaaaaaccatatggcgtagatatcaccataccaaaatttaaatttagttatgatttaggattaaaaaaagatttaaaaaatttaggaataaatgatacttttgaaagaaatgaagcaaacttatcaaaaatggaaaatccagaagaattaaagcaaaatctttttgtttctgatattcttcataaagctgatattgaatttactgaaaagggagtaaaagcagctgcagtaactgttgttgtaatattacctggaagtgcaggaccatccaataaaaaaacaccattatatattacaatagatagaccatttatgtttattataagagataaaaatactaaagatatatggtttaccggtacagtatataaaccaaa

SEQ ID NO: 26896 - DNA, 1074 bp, Anaeromyces robustus
  Serpin
aaaattagaaaataataaggaaaatatgctttatagtccattatctataaaatatgctttaagaatgttattagaaggagctgaaggtaatacttatacggaattaattaaattaataggaaatgaagaacttaatccatacacaaatattgataaagtattatccttagccaatggattattcataagagatacctattatacttgtataagaccagaatatatagataccttaaaagaaaaatataatgcagatgttgtaaaagatgaatttaaaagtgcttataatgctaataaatggattgagaagaatactttaggtattattaaaaatatgcttaatgataatattgttcaaaacccagaaactataatgcttttaattaatgcccttgctatagaaatggaatggtattctccatttaattgtaattatactagtggaaccactttttatactgaggatgatgatgaaaccatagaagcaacaatgatgtctcgtgtaactggagataatagtttatcctatagtatcaatgatgatgttacagtggttaccatggatttaaataaatatggcagtactcaatttgaatttatggctatcatgccaaccaaagaaaatttaagtacttttattgaaaaggtaaccaaagaaaccattaatgaaatagataaaaatcttatatttgcttctgaaaaaccatatggcgtagatatcaccataccaaaatttaaatttagttatgatttaggattaaaaaaagatttaaaaaatttaggaataaatgatacttttgaaagaaatgaagcaaacttatcaaaaatggaaaatccagaagaattaaagcaaaatctttttgtttctgatattcttcataaagctgatattgaatttactgaaaagggagtaaaagcagctgcagtaactgttgttgtaatattacctggaagtgcaggaccatccaataaaaaaacaccattatatattacaatagatagaccatttatgtttattataagagataaaaatactaaagatatatggtttaccggtacagtatataaaccaaa

SEQ ID NO: 26897 - DNA, 33 bp, Anaeromyces robustus
  SERPIN
tacaatagatagaccatttatgtttattataag

SEQ ID NO: 26898 - DNA, 1071 bp, Anaeromyces robustus
  SERPIN
tgaattcttaaaaatggaaaatccaaaggataatatgatatatagtccattatctattgaatatgctttaaaaatgttacaagaaggagcaaatagtaatacacttgatgaaattaataaagttgtcaaaggtatggagcttcctaaatatacaaacattgataatattttatcattagcaaatggattttttataagagatatatattataaaaatgtaaaaacagaatatataaatacgttaaaagaaaaatatgacgcagatgtaatagaagatgaatttgaaaatgctgataatgttaatcaatggattaaagataaaactttagaaatcattaaaaatgtgcttaatgatgaggtagttcatgatccaagtattttaatgattttagtaaatgcacttgcaatagatatgcaatgggctaaggtgttcgatactaaagaaactcgtggtgaaatattttataaggataatggcgaaaaaataatggcaacaatgatgtttaataaagaagtaagttgcgattgtatatcatattatatagatgatgacttaacagttgtttcaatggatttaagggaatatgaaggaacacaacttgaatttatggccattatgccaaaagataatttaagtgattatgttaaaaatgtaacaaaagaacaaataaatgaaataactaaaaatcttaaatcttcattaaattcacatgatggagttaatgtaaaaataccaaaattcaattttgattataatttaaatttaaaaaaagacttaatggatttaggtattatagatgtttttgatgtaaatagagcagaccttacaaaaatatcagaaaatccaatcgatcgtttatatattgcagatgcacttcataaagcaaatattgaatttaccgaaagtggagtaaaagccgcagcagtaacagttatgattggaggatggggtgcaatgatgccaattaataaacatccaattaacgtaataatcaatcaaccatttatgtttattataagagataaaaatacaaaagatatatggtttacaggaacagtctatgaaccaaa

SEQ ID NO: 26899 - DNA, 1089 bp, Anaeromyces robustus
  Serpin
taataatgattttgaatttgaattcttaaaaatggaaaatccaaaggataatatgatatatagtccattatctattgaatatgctttaaaaatgttacaagaaggagcaaatagtaatacacttgatgaaattaataaagttgtcaaaggtatggagcttcctaaatatacaaacattgataatattttatcattagcaaatggattttttataagagatatatattataaaaatgtaaaaacagaatatataaatacgttaaaagaaaaatatgacgcagatgtaatagaagatgaatttgaaaatgctgataatgttaatcaatggattaaagataaaactttagaaatcattaaaaatgtgcttaatgatgaggtagttcatgatccaagtattttaatgattttagtaaatgcacttgcaatagatatgcaatgggctaaggtgttcgatactaaagaaactcgtggtgaaatattttataaggataatggcgaaaaaataatggcaacaatgatgtttaataaagaagtaagttgcgattgtatatcatattatatagatgatgacttaacagttgtttcaatggatttaagggaatatgaaggaacacaacttgaatttatggccattatgccaaaagataatttaagtgattatgttaaaaatgtaacaaaagaacaaataaatgaaataactaaaaatcttaaatcttcattaaattcacatgatggagttaatgtaaaaataccaaaattcaattttgattataatttaaatttaaaaaaagacttaatggatttaggtattatagatgtttttgatgtaaatagagcagaccttacaaaaatatcagaaaatccaatcgatcgtttatatattgcagatgcacttcataaagcaaatattgaatttaccgaaagtggagtaaaagccgcagcagtaacagttatgattggaggatggggtgcaatgatgccaattaataaacatccaattaacgtaataatcaatcaaccatttatgtttattataagagataaaaatacaaaagatatatggtttacaggaacagtctatgaaccaaa

SEQ ID NO: 26900 - DNA, 33 bp, Anaeromyces robustus
  SERPIN
aataatcaatcaaccatttatgtttattataag

SEQ ID NO: 26901 - DNA, 1086 bp, Anaeromyces robustus
  SERPIN
tgatttttcatttttaaaattagaaaacaataaagaaaatatgctttatagtccattatctataaaatatgctttaaaaatgttattagaaggagcagatggtaatacttataatgaaataagtaaattagtaggaaattcagaacttactaaatgttcaaacattgataaagtattatcattagccaatggtttattcataagagatacgttttatacatgtataaacccagaatatataaaaacattagaagaaaaatataattcagaagtagtaaaagatgaatttaaaaatgctgataatgttaatgaatggattgaaaataaaactttaggtattattaaaaaaatgttagatgataaaaaggttcaagatccatcaagtgtaatgcttttaatcaatgcacttgccatagaaatggattggtattctgcatttaaaattgaaagtacttatggaaatacattttatattgatgatgataaaaaagtggaagcaactatgatgtctcaaaaagtttatagtaataatttatcatattatttaagtgatgagttaacggctgttactatggatttaaaggaatatggtggaactcaatttgaatttatggcaataatgccaaccaaagataatttaagtacttttattgaaaatgtcaccaagaaacaaattaatgaaatagatgaaaaacttatattagcctccgaagctgaatatggagttattatcaaaataccaaaattcaaatttagttatgatttaaaattaaaagatgatttaaaaagtttaggaataaaagatgcttttgatatgagtagagccaacttttcaaaaatggaaaatccatcagaattaacacaaaacctttatgtttctgatgcacttcataaagcagatattgaatttaccgaaaagggaataaaagcagctgcagttactgttatcataattacttatggaagtgcaggaccatccaaaccaacaacaccagtatatgttaccattgatagaccatttatgtttattataagagataagaataccaaagatatatggtttaccggaaccgtatataaaccaaa

SEQ ID NO: 26902 - DNA, 1095 bp, Anaeromyces robustus
  Serpin
ctctgattttgatttttcatttttaaaattagaaaacaataaagaaaatatgctttatagtccattatctataaaatatgctttaaaaatgttattagaaggagcagatggtaatacttataatgaaataagtaaattagtaggaaattcagaacttactaaatgttcaaacattgataaagtattatcattagccaatggtttattcataagagatacgttttatacatgtataaacccagaatatataaaaacattagaagaaaaatataattcagaagtagtaaaagatgaatttaaaaatgctgataatgttaatgaatggattgaaaataaaactttaggtattattaaaaaaatgttagatgataaaaaggttcaagatccatcaagtgtaatgcttttaatcaatgcacttgccatagaaatggattggtattctgcatttaaaattgaaagtacttatggaaatacattttatattgatgatgataaaaaagtggaagcaactatgatgtctcaaaaagtttatagtaataatttatcatattatttaagtgatgagttaacggctgttactatggatttaaaggaatatggtggaactcaatttgaatttatggcaataatgccaaccaaagataatttaagtacttttattgaaaatgtcaccaagaaacaaattaatgaaatagatgaaaaacttatattagcctccgaagctgaatatggagttattatcaaaataccaaaattcaaatttagttatgatttaaaattaaaagatgatttaaaaagtttaggaataaaagatgcttttgatatgagtagagccaacttttcaaaaatggaaaatccatcagaattaacacaaaacctttatgtttctgatgcacttcataaagcagatattgaatttaccgaaaagggaataaaagcagctgcagttactgttatcataattacttatggaagtgcaggaccatccaaaccaacaacaccagtatatgttaccattgatagaccatttatgtttattataagagataagaataccaaagatatatggtttaccggaaccgtatataaaccaaa

SEQ ID NO: 26903 - DNA, 33 bp, Anaeromyces robustus
  SERPIN
taccattgatagaccatttatgtttattataag

SEQ ID NO: 26904 - DNA, 192 bp, Anaeromyces robustus
  Serpin
aaaaatagaaaataatcaatgtaatatgttatatagtccattatcgatagaatatgctttaaaaatgttacaagaaggagctaataataatactttaaatgaaattaatgaagttatcaaagatattgaacttacaactaaatatacagctattgataaagttttatccttagccaatggattatttataag

SEQ ID NO: 26905 - DNA, 1044 bp, Neocallimastix californiae
  Serpins
aatcttgtcaaaattaggtggtaaaaagaattttgcttattctccagaatcccttaatattgctcttaagttgtacgaagagttccttgtggatggagaggaaaaaaaagaaattcttaatcttattggtaataaaaattatcttgattataaaaattctttgagttctaagattgtcaatagaatatggattgatagtaaaaaaaagtatgacttctcatcagtcgtaaaaatggaaaaatatttatatgcaatagacatgtctgccgataatgctaaggagattaaagatgcctatgtatcagaagtcactgatggatttattacatctactccaactgaatttagtagtaaaactatttatgattttatgaatattttatactttaagggaaaatggaataaagatgcaaacaattttagaataaagaatattttttttccattcaaaactatcgatggaaaggaatcacacgctacatccattggctttacaaaaaagaatggttactatttgaaaaatgatgatgctattgctgttaacctttactatgaaaaagaagaaatcgaaaattatgcaggatttcagatgattgtcattttacctaatgaagataagtccatcagtgatattgatattagaccatttcttccttatgattacgaagatgaagtaactccagcaaagttaaaaaataatttcgatgaattatattttgaaatgccaaaattctctgtggagacggaatggtttataaaatcaggtacaaaagaagcctctttatttgaacttgatcactttagtggcggttcattaaatcgtaacatttataatgcatctatatcagctgaaattagtcaagtggtaaggatagaatgtgatgaaaaaggtacaactgctgctgcagttactgaagttcacggctccgctaaagcattacctaaaacccctataatatttaattttatatgtaatcgtccattcatatatgttttatatgataatgtaaatgatgatattggatttgtaggtcaagtcatgac

SEQ ID NO: 26906 - DNA, 159 bp, Neocallimastix californiae
  Serpins
agatgattttgattttaatttttcatttttaaaattagaaaacttcaagaaaaatatgctctatagtccattttcaataaaatatgctttaaaaatgttacaagaaggagcagctaataatacttttgatgaaatcaataaattaataggaaatactca

SEQ ID NO: 26907 - DNA, 300 bp, Neocallimastix californiae
  Serpins
ttttaatttttcatttttaaaattagaaaacttcaagaaaaatatgctctatagtccattttcaataaaatatgccttaaaaatgttacaagaaggagcggctaatgatacttttgatgaaatcaataaattaataggaaatactaaactttctaaacacattagtattgacgaagttttatcgttagccaatggattatttataagagatacattttataaatatataaatacaaattatataaatactttaaaggaaaactatgatgcagaagttgttaaagatgaatttaaaagtgc

SEQ ID NO: 26908 - DNA, 859 bp, Neocallimastix californiae
  Serpins
tgttgtttataatgctgaagatgattttgattttaatttttcatttttaaaattagaaaacttcaagaaaaatatgctctatagtccattttcaataaaatatgctttaaaaatgttacaagaaggagcagctaataatacttttgatgaaatcaataaattaataggaaatactcaactttctaaatacaccaacattgacgaagttttatctttagctaatggattatttataagagatactttttatgactatataaatacaaattatataaatactctaaaggaaaattatgatgcagaagttgttaaagatgaatttaaaaatgcagcaaatgctaataaatggattgaagataaaacatttaatatcattaaaaatatgctcactgatgaaatgattaaaaatccaactagcgtcatgcttatcatcaatgcccttgccatagatatggaatggaaagaaggattttcatttcagtatactgatggagattatttttatttagataatggtgaaaaaatgaaggcaacaacgatgtatagaaaagaatttggtacaattttaagttattatattgatgattccgtcactgtagtgacattagatttaaaaaaatatggtaatatacaatttgaatttatggccatcatgccaaagggaaatttaagtagttttatcgaaaatttcactgaagaacaaatggatcatatcaataaaaatcttaattttgccaataatgtagaagatggagtagtgttatacataccgaaattcaaatttaattatgacttaaaattaaaacaagatttaattaatttaggtataaaagatgcctttaattatagtaaatccgac

SEQ ID NO: 26909 - DNA, 1089 bp, Neocallimastix californiae; identical to SEQ ID NO: 26886
  Serpins

SEQ ID NO: 26910 - DNA, 1092 bp, Anaeromyces robustus; identical to SEQ ID NO: 26889
  Serpins

SEQ ID NO: 26911 - DNA, 1086 bp, Anaeromyces robustus
  Serpins
ttttgaatttttattcttaaaattagaaaatcataaagaaaatatgttatatagtccattatccatagaatatgctttaaatatgttacaagaaggtgccgatggaaatacttatgatgaaataaataaaattataggaaatgacgaacttcctaaatacaccaatattgaaaataatttatccttagctaatggtgtatttataaaggatacattctatgaaaatgttaaaactgattatatcaatacattaaaagaaaaatttgattccgaagttatccaagatccatttgaaagtgctgaaaatgttaatcattggattgaagataaaactttaggtattattaaaaatgttgttaatgatgatgccgttagaagtccagctatggctatgcttttaattaatgctcttgctatggatatggattggaaaatcttatttgatagttatgatactaatgaagaaaacttttatatggaaaatggtcaaagaattcaagtatctatgatgaataaaaaagaaattaaaagtgatgtcgtttcctattataaaagtaataaagtcaaagctgttactatggaatttgaagaatataatggaacagaattagaatttttagcccttatgcctaatgaagatttaagtagttttgttgaaaatattacattagaacaaattcaaaaattagatcaaaaacttattccttcctctgaaacttctaatggagttaatttaaaaataccaaaattcaaatttagttatgatttagctttaaaaaagaatttaatggatttaggaatcaatgatgcttttgatgaattaaaagctaactttacaaaaatctctgatccttattcttctggaatgaatttatttgtttccgatgctcttcataaagcagatattgaatttaccgaaaagggagtaaaagcagccgcagtaactgtagctttaacttatgctacttcatttagaccaaaaaagggtgatcctattgaaatagttatagataaaccatttatgtttattataagagataaaaataccaaagatatatggtttacaggaactgtctatgaaccaga

SEQ ID NO: 26912 - DNA, 1134 bp, Anaeromyces robustus
  Serpins
ttgttctaaaaatgtcgaggatattattcaaggtgatcctgattttgatttttccttcttaaaattagaaaataataaggaaaatatgctttatagtccattatctataaaatatgctttaagaatgttattagaaggagctgaaggtaatacttatacggaattaattaaattaataggaaatgaagaacttaatccatacacaaatattgataaagtattatccttagccaatggattattcataagagatacctattatacttgtataagaccagaatatatagataccttaaaagaaaaatataatgcagatgttgtaaaagatgaatttaaaagtgcttataatgctaataaatggattgagaagaatactttaggtattattaaaaatatgcttaatgataatattgttcaaaacccagaaactataatgcttttaattaatgcccttgctatagaaatggaatggtattctccatttaattgtaattatactagtggaaccactttttatactgaggatgatgatgaaaccatagaagcaacaatgatgtctcgtgtaactggagataatagtttatcctatagtatcaatgatgatgttacagtggttaccatggatttaaataaatatggcagtactcaatttgaatttatggctatcatgccaaccaaagaaaatttaagtacttttattgaaaaggtaaccaaagaaaccattaatgaaatagataaaaatcttatatttgcttctgaaaaaccatatggcgtagatatcaccataccaaaatttaaatttagttatgatttaggattaaaaaaagatttaaaaaatttaggaataaatgatacttttgaaagaaatgaagcaaacttatcaaaaatggaaaatccagaagaattaaagcaaaatctttttgtttctgatattcttcataaagctgatattgaatttactgaaaagggagtaaaagcagctgcagtaactgttgttgtaatattacctggaagtgcaggaccatccaataaaaaaacaccattatatattacaatagatagaccatttatgtttattataagagataaaaatactaaagatatatggtttaccggtacagtatataaaccaaa

SEQ ID NO: 26913 - DNA, 1095 bp, Anaeromyces robustus
  Serpins
ttctagtaataatgattttgaatttgaattcttaaaaatggaaaatccaaaggataatatgatatatagtccattatctattgaatatgctttaaaaatgttacaagaaggagcaaatagtaatacacttgatgaaattaataaagttgtcaaaggtatggagcttcctaaatatacaaacattgataatattttatcattagcaaatggattttttataagagatatatattataaaaatgtaaaaacagaatatataaatacgttaaaagaaaaatatgacgcagatgtaatagaagatgaatttgaaaatgctgataatgttaatcaatggattaaagataaaactttagaaatcattaaaaatgtgcttaatgatgaggtagttcatgatccaagtattttaatgattttagtaaatgcacttgcaatagatatgcaatgggctaaggtgttcgatactaaagaaactcgtggtgaaatattttataaggataatggcgaaaaaataatggcaacaatgatgtttaataaagaagtaagttgcgattgtatatcatattatatagatgatgacttaacagttgtttcaatggatttaagggaatatgaaggaacacaacttgaatttatggccattatgccaaaagataatttaagtgattatgttaaaaatgtaacaaaagaacaaataaatgaaataactaaaaatcttaaatcttcattaaattcacatgatggagttaatgtaaaaataccaaaattcaattttgattataatttaaatttaaaaaaagacttaatggatttaggtattatagatgtttttgatgtaaatagagcagaccttacaaaaatatcagaaaatccaatcgatcgtttatatattgcagatgcacttcataaagcaaatattgaatttaccgaaagtggagtaaaagccgcagcagtaacagttatgattggaggatggggtgcaatgatgccaattaataaacatccaattaacgtaataatcaatcaaccatttatgtttattataagagataaaaatacaaaagatatatggtttacaggaacagtctatgaaccaaa

SEQ ID NO: 26914 - DNA, 1212 bp, Anaeromyces robustus
  Serpins
atgttgtcaatcgtgcaaagtattatacactgataaatctggtaaatggggtgtagaaaatggtaaatggtgtggtataaaggacaattgtaccaatgatgttgtagtagaatataactctgattttgatttttcatttttaaaattagaaaacaataaagaaaatatgctttatagtccattatctataaaatatgctttaaaaatgttattagaaggagcagatggtaatacttataatgaaataagtaaattagtaggaaattcagaacttactaaatgttcaaacattgataaagtattatcattagccaatggtttattcataagagatacgttttatacatgtataaacccagaatatataaaaacattagaagaaaaatataattcagaagtagtaaaagatgaatttaaaaatgctgataatgttaatgaatggattgaaaataaaactttaggtattattaaaaaaatgttagatgataaaaaggttcaagatccatcaagtgtaatgcttttaatcaatgcacttgccatagaaatggattggtattctgcatttaaaattgaaagtacttatggaaatacattttatattgatgatgataaaaaagtggaagcaactatgatgtctcaaaaagtttatagtaataatttatcatattatttaagtgatgagttaacggctgttactatggatttaaaggaatatggtggaactcaatttgaatttatggcaataatgccaaccaaagataatttaagtacttttattgaaaatgtcaccaagaaacaaattaatgaaatagatgaaaaacttatattagcctccgaagctgaatatggagttattatcaaaataccaaaattcaaatttagttatgatttaaaattaaaagatgatttaaaaagtttaggaataaaagatgcttttgatatgagtagagccaacttttcaaaaatggaaaatccatcagaattaacacaaaacctttatgtttctgatgcacttcataaagcagatattgaatttaccgaaaagggaataaaagcagctgcagttactgttatcataattacttatggaagtgcaggaccatccaaaccaacaacaccagtatatgttaccattgatagaccatttatgtttattataagagataagaataccaaagatatatggtttaccggaaccgtatataaaccaaa

SEQ ID NO: 26915 - DNA, 237 bp, Anaeromyces robustus
  Serpins
ttctattcatcataattttgaattttcatttttaaaaatagaaaataatcaatgtaatatgttatatagtccattatcgatagaatatgctttaaaaatgttacaagaaggagctaataataatactttaaatgaaattaatgaagttatcaaagatattgaacttacaactaaatatacagctattgataaagttttatccttagccaatggattatttataagagatacgtattt

SEQ ID NO: 26916 - DNA, 783 bp, Neocallimastix californiae
  SGNH hydrolase
cttccatatttatttagcctttggtcaatctaatatggaaggtcaaggtccaattggaagtcaagatagaactgttgataagcgtttccaaatgatttcaactgttagtggatgtaatggtcgtcaaatgggtaattggtatgatgctatcccaccacttgctaattgtgatggtaagttaggtccagtcgattactttggacgtactttagttaagaatttaccacaagaaattaaggttggtgttgctgttgttgctgttgctggttgtgatattcaacttttcgaaaagaataactacagaaactacagattagaaagttacatgcaaggtagagttaatgcctatggtggtaacccatatggtcgtttaattgaagttgctaagaaagctcaacaagttggtgtcatcaagggaattcttcttcaccaaggtgaaactaacactggtcaacaaaactggccaaaccgtgttaaggctatctatgaagatatgcttaaggacttaggtttaaatgctaaggatgttccacttcttgctggtgaagttgttcaaagtaaccaaggtggtcaatgtggtagtatgaattctattattcaaagacttccatctgttattccaaccgctcatgttatttcttctcaaggtttaggtcaacaaggtgatggtcttcacttctcttctcaagcttaccgtactttcggtgaacgttatgctaatgaaatgttaaagattcttggtgatgttaagccagttgctaaaactaccaccactactagaaa

SEQ ID NO: 26917 - DNA, 768 bp, Neocallimastix californiae
  SGNH hydrolase
ttttcatatatatttggcttttggtcaatctaacatggaaggacaaggtcctattgagcctcaagatagaataccagaaaaacgttatcaagtactttcaacttttggtaattgtgacggtcgtgaagtcggtaaatggtatgatgcagttcctcctcttgctagatgttttgctagagttggaccaatggattattttggtcgtacattagctaaaaaattaccagaagaaattaaaattggtgcagtcattgttgctgttggtggatgtagtattcaactttttgaaaaagataactatatgaattataaattagaaaattatatggttgatgtagttaaaaactatggtggtaatccttataagcgtttaattgatgtagctaaattagctcaaaaagatggtgtcattaaaggaattcttcttcatcaaggtgaatctaacaatggtcaaactaactggccctatcgagttaaagcagtctatgaaaatattcttaatgatttaggattgaaagcagaagaagttccgcttcttgctggtgaagtcgttcaaacaagtgaaggtggtcaatgtggtggtatgaataaaattattaatactcttcccaatgttattccaacagctcatgtcgtttcatcagtaggtttaaaacaacaaggagatggttatcatttttcaacggaggcttaccgtgaatttggtgaacgttatgctgaagaaatgttaaaaattcttggtgatgttaaagtcattgatacatctga

SEQ ID NO: 26918 - DNA, 375 bp, Neocallimastix californiae
  SGNH hydrolase
catttctgatgaagctcatgatttctctgagagaaaagctccagatcttatgattattttccttggtactaatgatgctggtaatgatgcaaaagttgttgctgaagattattatgaaactttaaagaaattccttactagagttagagaaatttatccagaaacaccacttgcaatcacttcacttttatatgatccaggaaactggaatgaaattcaatctaatattgtaaatgaatttgataatatttactatatctacatcaatgatccagttataaattcatcaccaaatatttacttaactaactaccatcttactcaaaagggtagttgtgctcttatgaaaactatggttgaaaaagttagtcaaca

SEQ ID NO: 26919 - DNA, 138 bp, Neocallimastix californiae
  SGNH hydrolase
tcaaattgttggtgattctttaactgctggtcaatatttaccaaatgaacaagctgattcttggtctttcttattcggtaaatatatgaatgctgaaacagatattatcgctaagccaggtatttgtttatcagatat

SEQ ID NO: 26920 - DNA, 768 bp, Neocallimastix californiae
  SGNH hydrolase
tttccatatttatttggcatttggtcaatctaatatgcaaggggatggtaaaattgaaaaccaagatagagttgttgataaacgtttcaaaatgttagctactgcaggaggatgtaataatagaagagttggtgaatggtatgatgctattcctccacttgctaattgtgctggtggtttaggtccagttgattattttggacgtacattacttaaaaaattaccagaacaaattaaggtaggtgttgctgttgttgccgttgctggttgtgatattcaactttttgaaaaagataactacagaagttataatatgccagattggatggttggtattgttaatggttacaatggtaatccatatggacgtttaattgaaatgggtaagaaggccaaggaagctggtgtcattaaaggtattcttcttcatcaaggtgaaactaacactggtcaacaagactggccagatcgtgttaagaaaatttatcaaaatattattaatgatttaagtttaaatgctgatgaagttccacttcttgttggtgaagtagttaatgctgattctggaggtgcctgtgcttatcataacgaagttattaaaagagttccacaacttattaaaaattcatacgtcatatcttctaaaggtttaccacaaaagggtgatggacttcactttacttcagccggttatcgtacatttggtgaacgttttgctgatactatgttaaaaattcttggtaacgttagtgttgttgataatggaag

SEQ ID NO: 26921 - DNA, 195 bp, Neocallimastix californiae
  SGNH hydrolase
tgcttatcataacgaagttattaaaagagttccacaacttattaaaaattcatacgtcatatcttctaaaggtttaccacaaaagggtgatggacttcactttacttcagccggttatcgtacatttggtgaacgttttgctgatactatgttaaaaattcttggtaacgttagtgttgttgataatggaagtca

SEQ ID NO: 26922 - DNA, 618 bp, Neocallimastix californiae
  SGNH hydrolase
ttataaggctgttgtctgttttggtgattctattactgatggtagaggtgttactaatgataagaataacagatggactgatattctcgctaccagattacaacagaatccagcaacaaaaaatattggtgtattaaaccaaggtattggtgctactactgtagctggaacttactataatccaactagtccagctggtcaagctagatttgaaaaagatgtcttgaaacaaacaaatgttaaatacttaattatcttatacggtgttaatgatattctctacaataatagtaatgctcaaactatcattaatgtttataaagatttaattaaaaaggctcacaacaatggaattaaggttttcggaggtacaattttaccattcggtaaaaacagtggtttcaactcaaataaggaaagtcaaagaacaactgttaataactggattatgaacacaccagcttctcaaggtggttttgatggttacattgactttgcttcagctgttgctgataaatctaacaaacaatggttgaatactaattggaactttgaaaatgatggtcttcatccaaatgctgttggttatgaagctatgggtaaagctattgatttaaa

SEQ ID NO: 26923 - DNA, 504 bp, Neocallimastix californiae
  SGNH hydrolase
atatgatgataataatgctggttacagtggattccaaatcaaagaaattccaggctggggtcaacaacaaggtggtgaaggaagtttatataataaacttaagagtaagaatgctgttaagcaatctcaaccagatatcattcttcttatcattggtactaatgatatgactgccaatcgttcaatggatgcttgtgccaatgatcttcgtgctctcttagattatatgcttgcagatatgccagccaatagtattatctttatgggttctattccagaatttactgcttacggtggtaatgctcaaagaattgccaattacaatggtacagttaagaaggttgctgacgaatacgctaataagggtaagaatgttagatttgctgatgttcatggttgtcttaacggtatgtctgatataggtagtgatcgacttcacccaagtggaaatggttacaaaaaaattggtaatttctgggctggagttatcgatgaataccttca

SEQ ID NO: 26924 - DNA, 84 bp, Neocallimastix californiae
  SGNH hydrolase
tgatactgttaaaattatgcctgttggtgattctatcacctttggtgaaggtgaaagaggtggatacagaaagtatctttacag

SEQ ID NO: 26925 - DNA, 753 bp, Neocallimastix californiae
  SGNH hydrolase
cttccatatttatttggcctttggtcaatctaatatgcaaggagcaggtcaaattgcaaatcaagataaaactgtagataaacgttttcaaatgttagccacagctggaggttgtaataatcgtcaagttggtaattggtatgatgctattcctccacttgctcattgtggtggaggtttaggtccagttgattactttggtcgtaatttaattaaaaacttaccttctcaaattaaagttggtgttgttgttgtcgctgtagctggatgtgatattcaactttttgaaaaggataattacagaagttataatatggctgactggatgaaaagtattgttaactcctatggaggtaatccatatggaagattagttgaaatgggtaaaaaggctcaacaagctggtgttattaaaggtattctcttccatcaaggtgaaactaacagtggtcaacaaaattggccaaatcgtgttaaaggtatctatgataatcttatcaaggatttaggcttaaaggcttcagaggttcctcttcttgctggtgaacttgtttctagtgctaaagggggtgtttgtggaggtcataatagtattattcaacgtcttccacaagttattccaaatgctcatgttatttcttctagtggattagatcaacaaggtgatggtctccacttcacatcagctgcttatcgtacttttggtcaacgtttcgctgagactatgttaaaacttcttggtgatgttaaaac

SEQ ID NO: 26926 - DNA, 750 bp, Neocallimastix californiae
  SGNH hydrolase
tttccatatttatttagcttttggtcaatctaatatggaaggtgctggtccaattgaaaatcaagatcgtcaagtcgataaacgttttaagatgctttccactgttagtggttgtggtcgtcaactcggtaattggtatgatgccaccccaccacttgctcactgtggtggtaaattaggtccagtagattactttggtcgtaatttagtaaagaatttaccagaacaaattaaggttggtgttgtcgttgttgctgttgcaggttgtgatatccaacttttcgaaaagaataattacaaaagttacaatatgccagattggatgagaaataccgttcaaaattatggtggtaatccatatggacgtttagttgatatggctaagaaagctcaacaagaaggtgttatcaagggtattcttcttcaccaaggtgaaactaatagtggacaacaaaattggccaaaccgtgttaaggatatttacaataaccttattaaggatttaggattaaatgctaatgatgttccacttcttgctggtgaagtcgtttccagtgaacaaggtggttcctgtggtggtcataactctatcattcaaaagcttccatcagtcattcctactgcacatgttatttcctctaaaggtttaggtcaacaaggtgatggtcttcactttacttctgcttcataccgtaccttcggtcaacgttacgctgatgaaatgttaaagattctcggtaatgtaaaggt

SEQ ID NO: 26927 - DNA, 786 bp, Neocallimastix californiae
  SGNH hydrolase
tttccatatttatttagcttttggtcaatctaatatggaaggtcaaggtccaattgaagctcaagataaaaccgttgatagtcgtttcaaaatgctctcaactgttgatggatgtaataaccgtagtttaggtgaatggtatgaagctattccaccacttgccaattgtgatggtagacttggtccagtcgattactttggtcgtactttagttaaaaaattaccagaacaaattaaggttggtgccgttgttgttgctgttgctggttgtgatattcaacttttcgaaaaggataattacattgaatactcaaaggaacaaccagattggatggttggtagaattaatgcttatggtggtaatccatatggtcgtttagttgatatggctaagaaggctcaagaagttggtgtcatcaagggaattcttttccaccaaggtgaaactaacaacggacaagttacctggccttctcgtgttaaagccgtatacaacgaccttctttctgatttaggtttaaaggctgaaaatgttcctcttcttgctggtgaagttgttccagaaagtgttaatggtttatgtgctgctatgaatgatatcattaaaactcttccagaaaccattccaacagctcatgttatttcttctgaaggtttagaaccacaagatgataatcttcacttctcttctgctgcttaccgtacttttggtgagcgttatgctgaaaccatgttagaattacttggtgatgttgaagttgttgataatacttctgaatgttggtc

SEQ ID NO: 26928 - DNA, 774 bp, Neocallimastix californiae
  SGNH hydrolase
agatttaattgtttttggtgattcttatacaactgcaactattgattattctactttacaatttaacggtcaaagcagtaataatgaagaagaaagtaaaaattggcctttgtttttagttaaaaaacgtattatgaatatgtggaattttgcttgtagtggagctgtagtagacaatgatattattcatagtaataatgcattgccaatgacagaacaatataaagcttttattttacatatgggtaaaggtggaaaacactcaaattggagaagtgatcagtcattaataggtatctggtttggtatcaatgatataatgaatagagcagataatgatattgattatgatgatgatcaatcaattataaaaagtatgtttaaaataattaataagatttatgatcttggagctcgtaattttttgattttggatgttccatctcttgaaaaacttccacatttcatatacagtcctgtaaagggattagacgaagaagtgttaaaattcaataaaatgattgcggatagtgctatgaattttcaaaaatcaaaaccagaaactaacgtttttgtatataatgcttataatgaattaaattatataatgaaaaatgaaaataaatttggtttcaccattacagttgacgattggtatcataataatgaaagaaaacttgaagatattacaaaagaatatttttggagagatggttatcatctatctaaatatgttcaagaagctttaagccaagaacttgatgatttcttgag

SEQ ID NO: 26929 - DNA, 588 bp, Neocallimastix californiae
  SGNH hydrolase
tattatcatttttggtgattcatatactactgttggtattaacttcaataccatgaaatatactggagataatttatctggaggtaagaattggcctcaattcttaatcgatatgcacccaatgaatatgtggaattttgctattagtggtgctgttgttgacgcaaaagttgttgatggtaatcctcaatatactccaatgactgaacaatataattggttccttaaaaatatggctcctggaaagcaatttagtaattggaaaggtgaatcttctttatttgctatttggtttggtattaatgatattggtagtaaaagacgtaatgaaggtttaactagttctcaaattgatgagaaaattgccacttctatgtttaatatgattgatggtatgtataaacaaggagctagaaacttcatgttcatctttgttcctacaatagaaaaatgtccagcttattctaatggtaataatccaaatatcaaatctgatataccaaattataatagtaatcttaataaatatgcaaaaaatttccaagcttctcatccagatactaatgtctttgtttatgattcctacaa

SEQ ID NO: 26930 - DNA, 111 bp, Neocallimastix californiae
  SGNH hydrolase
caatcaaaataattgtgattccaacacttacttctggaaggatgtcattcacccaactccaactgttcacaagccattagctcaagatattgaagatttcttaattgaaaa

SEQ ID NO: 26931 - DNA, 375 bp, Neocallimastix californiae
  SGNH hydrolase
tgatgatgatgctgaatatgatttctctaagaggaaggcccctgaacttattattatttatatgggtaataatgatagtggtaaggaagatccaattgctcctgaagattactttgaaactttaaagaaattcattactagaataagaggtatttatccaaattcaaagattattgtcacctcagcttttgatagtagaccacactgggataccgttcaagaacatattccagaatactttgatgatctctactacattccaacctatgaatttggtcttattgaagctccatacgtttatcctcaaaattatcattacactcaattaggtaattgtttattcttaaagaatatcattgaaaagatttctgaggt

SEQ ID NO: 26932 - DNA, 135 bp, Neocallimastix californiae
  SGNH hydrolase
agttattggtgattctttaagtgcaggtcaatattgtccaaatgaagctcttgatgcttgggctttcttacttggtaaagctatgaatgttgaagtagatgttatcgctaagccaggtgcatgtttaaccgatgt

SEQ ID NO: 26933 - DNA, 768 bp, Neocallimastix californiae
  SGNH hydrolase
tttccatatttatttagcttttggtcaatctaatatgcaaggtgcaggtcaaattgaaaatcaagataaaaccgttgataaacgttttcaaatgattgctacagctgctggatgtaataatcgtagagttggtgaatggtatgatgctattccaccacttgctcattgtggtggtggtttaggtccagttgattattttggtcgtactttagttaaaaaattaccagaacaaattaaagttggtgtagctgttgtagctgttgctggttgtgatattcaactttttgaaaagaataattatagaagttataatatggcagattggatgaaaggtattgttgattcttatggtggtaatccatatggtcgtttaattgatatgggtaaaaaagctcaacaagttggtgttattaaaggtatacttcttcatcaaggtgaaactaataatggacaaagtgattggccaaatcgtgttaaagctatttatgaagatattcttaaagatttaagtttaaaagctgaagaagtcccacttcttgttggtgaaacagttgattctgattctggtggtgtttgtggttatcataatagtgttattgctagaattccacaagttattaagaatggtcatgttatttcttctaaaggtttaggacaacaaggagatggtcttcactttacctctgctgcttatcgtacttttggtgaacgttatgctgatactatgttaaaacttcttggtaatgttcaacctgttgaaggtggtga

SEQ ID NO: 26934 - DNA, 669 bp, Neocallimastix californiae
  SGNH hydrolase
aggggatgctataaaaattatgcctgttggtgattctattacctttggtatgggagaaaatggaggttatagaaaatatctttatagtgctttaactcaaaaaggttataatattgatatggtaggtccagaaggatcaagtagagctacagctaatggtatttcatatgatgataatcacgctggttatagtggattccaaatcaaggaaattcctgattggggtagacaacaaggtggtgatggtagtttatataataaacttaaaagtaaaaatgctgttaaacaagctcaaccagatattattcttcttattattggtactaatgatatgaccgctaatcgttctatggatgcttgtgcctcagatcttcgtgctcttttagattatatgcttggagatatgccatctggtggtattattttcatgggatctattcctgaatttacagcttatggtggtaatgctcaaagagttgcaaattataatggtactgttaaaaaggttgctgaagaatatgctagtaaaggtaaaaatgttagatttgcagatgttcatggtagtcttaatggtactggtgatcttggtggtgatggacttcaccctaatggaaatggttataaaaaaatgggtaacttttgggcagatgttattgataaatatcttaa

SEQ ID NO: 26935 - DNA, 798 bp, Neocallimastix californiae
  SGNH hydrolase
tttccatatttatttagcttttggtcaatcaaatatggaaggtaatggtccaattgaaagtcaagatagaactgttgacaagcgttttaagatgcttgctactgtaagtggatgtaacaatcgtcaagctggtaattggtatgatgctactccaccacttgccaactgtaatggtaaattaggtccagtcgattactttggtcgtactttagttaagaaattaccacaagaaattagaattggtgccgttgttgttgctgttgccggttgtgatattcaacttttcgaaaaggataagtaccgtagctaccaacaaccagattggatgcgtggtattgttcaacaatacggtggtaatccatatggtcgtttaattgaaatggctaagaaggcccaacaagaaggtatcatcaagggtattcttcttcaccaaggtgaaactaacactggtcaacaagactggccaaaccgtgttaaaggtatttacgaaaatattcttaatgatttaggtttaaaagctgaagatgttccacttttagctggtgaagttgtttctagtgctgttggtggtcaatgtggttctcataatgctgtcattcaaagacttccaagtgttatcaagactgctcatgttatttcttctcaaggtttacaacatcaaggtgatggtcttcactttacttcagctgcttaccgtactttcggtgaacgttatgctgaagaaatgttaaagattcttggtgatgttcaagttgttggtaagactactaccactactactgttaaaactactactac

SEQ ID NO: 26936 - DNA, 768 bp, Anaeromyces robustus; identical to SEQ ID NO: 26933
  SGNH hydrolase

SEQ ID NO: 26937 - DNA, 669 bp, Anaeromyces robustus; identical to SEQ ID NO: 26934
  SGNH hydrolase

SEQ ID NO: 26938 - DNA, 798 bp, Anaeromyces robustus; identical to SEQ ID NO: 26935
  SGNH hydrolase

SEQ ID NO: 26939 - DNA, 771 bp, Anaeromyces robustus
  SGNH hydrolase
tttccatatttatttagcatttggacaatctaatatgtatggaagtggtgatattgaagaacaagataagactgttgacagtcgtttccaaatggtttccactgtaaatgattgtggatctcgtaaattaggtacttggtatgatgccattccaccacttgctacttgtgatgctggtttaggtccagctgattactttggtcgtactttagttgaaactttaccaaaggaaattaaagttggtattgctgttgttgcagttccaggttgtgatattcaacttttcgaaaaagataattaccaaaattatttcccagatgattggatgtatccatttattgatgaatatggaggtaatccatatggtcgtttagttgaaatgggtaagcaagctaaagaattaggtgttattaagggtattcttcttcaccaaggtgaaactaacaatgaacaaactgactggccattacgtgttaaggctatttatgaaaatcttcttacagatttagaattaaaggctgaagaagttccaattcttattggtgaacttgttcaattaagtgaaaacggtacttgtggtgctatgaatgctattattcaaactgttccaagtgtcattccaactgctcatgttatttcttctgaaggtttaaaacaacgtggtgatggtttccactttacttctccatcctatcgtgtctttggtcaacgttatgctgaagttatgttagaccttcttaaggacactactccagttaatgatgaatgttt

SEQ ID NO: 26940 - DNA, 753 bp, Anaeromyces robustus
  SGNH hydrolase
cttccatatatatttagctttcggtcaatctaatatggaaggtgctggtccaattgaaggacaagataaaactgttgataaacgtttccaaatgctttcaactacttcatgtaatggacgtcaaatgggtaattggtatgatgccactccaccacttgctcactgtggtggtaaattaggtccagttgattatttcggtcgtactttagttaaaaaattaccagaacaaattaaagttggtgttgtagttgttgccgttgctggttgtgatattcaacttttcgaaaaagataattataagagttataatatgccagattggatgagaaataccgttcaaaattatggtggtaatccatatggtcgtttagttgaaatggctaaaaaagctcaacaatctggtgttattaaaggtattcttcttcaccaaggtgaaactaactctggacaacaaaattggccaggtcgtgttaaggctatttataataatcttcttactgatttaggtttaaatgctaatgatgtaccacttcttgctggtgaagttgtttctagtggtcaaggtggttcttgtggtggtatgaattctattattcaaagtcttccacaaactattccaactgctcatgttgtttcttctgatggtttaggtcaacaaggtgatggtcttcactttacttctgcttcttaccgtacttttggtgaacgttatgctaatgaaatgttaaaacttcttggtgatgttaaggttga

SEQ ID NO: 26941 - DNA, 816 bp, Anaeromyces robustus
  SGNH hydrolase
cttccatatttacttagccttcggtcaatctaatatggaaggtcaaggtccaattggacaacaagatagatccgttgataaacgtttccaaatgatttcaactgtcaatggttgtaatggtcgtagacttggtgaatggtatgatgctgttccaccactttcaagttgtagtggtaaattaggtccagtcgattatttcggtcgtactttagtaaagaaattaccacaagaaattaaagtaggtgttgctgttgttgctattgctggttgtgatattcaacttttcgaaaagaataattacagaaattatcaattacaatcttacatggttaacactgttaatgcttatggtggtaatccatatggacgtttaattgaaatgggtaagaaggctcaacaagttggtgttattaagggtattcttcttcaccaaggtgaaaccaacactggtcaacaaaactggccaaaccgtgttaaggctatttatgaagatattcttaaagatttaggattaaatgctaaggatgttccacttcttgctggtgaagttgtttcaagtcaacaaggtggtcaatgtggtagtatgaattctattattcaaagtcttccaagaactattccaactgctcacgttatttcatctcaaggtttaggtcaacaaggtgatggtcttcacttctcatctgatgcttaccgtacttttggtcaacgttacgctgaagaaatgttaaagattcttggtgatgttcaagcagttaagtcaactactactaccagaagaactaccactactagaagaactactactactagaag

SEQ ID NO: 26942 - DNA, 780 bp, Anaeromyces robustus
  SGNH hydrolase
tatagttatttttggtgattcttatacaactgtttctgttgattttgaaactatgacatatactggacttaatttatcagggggtaaaaattggcctcaatttttaattgacatgcatttaatgaaaatgtggaattatgcagttggcggtgcttgtgttgacttaagtttgattaacggtgaccctgaaaatacaccaatgactgaccaatatgcttggttccttaaaaatatgtcaaaaggtaaaaaattcgcaaattgggatggtgatacttcattatttgttatatggtttggtattaatgatattaatggtatgtcaggtattgatgatgtattaaattctggaataaatgaaaaaatagctacctctatatttaatatggttgaaggaatgtataaagaaggtgctaaaaatttcttatttatttatgtaccttctcttgttaaatttccagcttatgccaatgaagatggtactggagtttataatgaaaatctttcttatgttattgatgaagttccagaatataataataatcttaatcaatatgccaaaaatttccaagaaattcatccagatactaatgtttttgtttataatgcttatgatgaatttgattatattatggaaaataaatcagaatatggtattgttaatataagagataaatgttcttatacttgtaatatgaaaacttatttctggaatgataattatcatccaacagctcatgttcataaaatattagcaaaagatattaatacctatttaaaaca

SEQ ID NO: 26943 - DNA, 582 bp, Anaeromyces robustus
  SGNH hydrolase
tttaattatttttggtgattcatatacaactgtcggtattgatttcaatactatgaagtatactggatctaatatgtctggaggtaaaaattggccacaatttttagttgatatgcatccaatgaatatgtggaattttgccattagtggtgctagtgttgatgctaaaattgttggtaatgctcaatttactccaatgactgaacaatacagttatttccaaagaaatatggcagctggtaaacaattttctggttggaaaggtgaaacttccttattctgtatttggtttggtatcaatgatcttggtgctgtaaatcataatggaggtgtaactactgctcaagttagtgaaagaattgctacatcaatgttcaatatgattgaaggtatgtacaaagaaggtggtagaaactttatgtttatttatgttccaccaattgaaaaatgtccagcttacaacagtggtcaaaattatatgaaaactgatgttccaatctataatgatatcattaacaagtatgctcaaaacttccaaaaatctcacccagatactaatatctttgtttacgattcttataa

SEQ ID NO: 26944 - DNA, 108 bp, Anaeromyces robustus
  SGNH hydrolase
cggtcaacaacaatgtgactctaacacctatttctggaaggatgttattcacccaactccaactgttcataaaccattagctgaagatatgaatgatttcttagtagc

SEQ ID NO: 26945 - DNA, 810 bp, Anaeromyces robustus
  SGNH hydrolase
tttccatatttatttagcttttggtcaatccaatatgttaagtggtgatattgaaagtcaagataaaaatgttgatagtcgttttaaaatgatttcaacggttaatgattgtggtaatcgtcgtcaaggtgaatggtatacggctgtaccaccattagctagttgtaatgctggtttaggtccagttccatattttggtaatactttagtagaaaaattaccaaaagaaattacagttggtgttgctgttgttggtattgctggttgtgatattcaactttttgaaaaagatagatatcaaagttatgaacatgcggattggatgacgggttatattaatgaatatggtggtaatccttatggacgtttagtagaaagtggtaaaattgctcaaaaatctggggtaattaaaggtattcttgttcatcaaggtgaaactaataatggtaatcaagattggccaaaacgtcttaaaggagtttatgaaaatcttcttaaagatttaagcttaaaagctgaagaagttccacttttagttggtgaacttgttcaatctaataaaggtggtatttgtggtgatatgaatagtattattcaaagagttccagaagttattccaacagctcatgttgtttcatctgaaggtttagaacaacaaggggatggttttcattttacttctgcttctcatcgtatacttggtaaacgttatgctgaagttatgttaagtattttagatggtactactccaataagtcaaaatggtagtgaagaacccgataaggatggttattatttccataatacttt

SEQ ID NO: 26946 - DNA, 756 bp, Anaeromyces robustus
  SGNH hydrolase
ttttcacatttatttagcatttggtcaatctaatatggaaggtcgtggtaaaatttatcaagaagataaaactgttgatagtcgtttccaaatgattgctactgtcgatggttgtaaaggtcgtaaatttggtgaatggaatgatgctattccaccactttcaaattgtaatatgggtcaattaggaccggctgattatttcggtcgtaccttagttaaaaaattaccacatgaaattaaaattggtattgctgttgttgctattggtgattgtgatattcaactttttgaaaaaacaaaaaatagaaattatcgaatcccaaatgagataaaaaatacttatgaagcctatggtcgtaattcatatagtcgtttaattgaaatgggtaaaaaagctcaagaagttggtgttattagaggtatacttcttcaccatggtgaaaataatataggtcaaactgactggccaaatcgtgttaaagctatttatgataacatacttaatgatttagatttaaattctgatgatgttccacttcttgctggtgaagttgtttcatctgaaaaaggtggaaaatatggtgaaatgaacccaatcattcataatcttgctaaaatttgttcaacttgtcacattatttcttctcaaaatttagattcagaagatgatggtttccatttcactacaaatgcttatcgtaccttaggtgaacgttatgctgaagaaatgttaaagatacataattataatcagtc

SEQ ID NO: 26947 - DNA, 450 bp, Piromyces finnis
  SGNH hydrolase
tggtaatccatatggtcgtttagttgacatgggtaagattgctcaaaaatcaggtgttatcaagggtattcttgttcatcaaggtgaaactaataatggtaatcaagactggccaaaacgtcttaagggtgtttatgaaaatcttcttacagatttaggtttaaaagcagaaaatgttccacttattgtaggtgaacttgttcaatccgataaaggtggtatttgtggtggtatgaataatatcattcaaactgtcccagaagttattccaacagctcatattgtttcatctgaaggattagaacaacaaggtgatggtttccactttacttctgcttctcatcgtattttaggtaaacgttatgccgaagttatgttaagtattttagatggaactacaccaatcaaacaaggcggtggtgaaccagataaggatggttattatttcca

SEQ ID NO: 26948 - DNA, 567 bp, Piromyces finnis
  SGNH hydrolase
agatattgttatctatggtgattcatacactactgtttccaccaactacaacactatggaatacactggtgaaaacttatcaaagggtaagaattggccacaacatttaattgatccaattcacccaatgaagatgtggaattttgctgctaatggtgctgttgttgatgctagaattgttggtcaatacactccaatgactgaacaatattcttacttcttaaaacatatgggtaagggtcaaaaattcaatacctggaagggagaaactacattattcacaatttggtttggtattaacgatcttttaagtaagcgtggtactggtacatctgttgatgaacaaattgctacttctatgtttgaaatgattgaaggtatgtacaatgaaggtggtagaaactttatgatcttcttcgttccagatgttagtaagagtcctctctactatggtaacgaaactcaaaagacttacattccagcatacaatcaaattcttaataagtacgctatgatgtaccaagcttctcacccagatactaacttcttcgtttacaatactttcag

SEQ ID NO: 26949 - DNA, 105 bp, Piromyces finnis
  SGNH hydrolase
aggtcaaagtaactgtgatgaaaagacttacttctgggctgataaccttcacccaagtccaaaggttcatgaagctttagcttatgatattgataagttcttaag

SEQ ID NO: 26950 - DNA, 567 bp, Piromyces finnis; identical to SEQ ID NO: 26948
  SGNH hydrolase

SEQ ID NO: 26951 - DNA, 105 bp, Piromyces finnis; identical to SEQ ID NO: 26949
  SGNH hydrolase

SEQ ID NO: 26952 - DNA, 567 bp, Piromyces finnis; identical to SEQ ID NO: 26948
  SGNH hydrolase

SEQ ID NO: 26953 - DNA, 105 bp, Piromyces finnis; identical to SEQ ID NO: 26949
  SGNH hydrolase

SEQ ID NO: 26954 - DNA, 87 bp, Piromyces finnis
  SGNH hydrolase
tgatggtcttcactttacatctgctgcttatcgtacttttggtgaacgttatgctgaaactatgttaaagcttctcgatggtaaggt

SEQ ID NO: 26955 - DNA, 87 bp, Piromyces finnis; identical to SEQ ID NO: 26954
  SGNH hydrolase

SEQ ID NO: 26956 - DNA, 294 bp, Piromyces finnis
  SGNH hydrolase
tttaaatgctagtgaagttccacttcttgctggtgaagttgttactagtgctcaaggtggtcaatgtggtagtatgaacaatattattgcccaacttccaaagactattccaactgcccacgttatctctgctcaaggtttaggtcaacaaggtgatggtcttcacttctcttctgctgcttaccgtacttttggtgaacgttacgctactgaaatgttaaagattcttggtgatgttaaggttgtcgacactaacccaaccactactgttaagaagactactactactactaa

SEQ ID NO: 26957 - DNA, 591 bp, Neocallimastix californiae
  SGNH_hydro-type_esterase_dom
tcaaattgttggtgattctttaactgctggtcaatatttaccaaatgaacaagctgattcttggtctttcttattcggtaaatatatgaatgctgaaacagatattatcgctaagccaggtatttgtttatcagatattccactttatggaatggatcatggtatggaagtttcctatttcttaaatagtaatccacttgcaagatcttggggatacatttctgatgaagctcatgatttctctgagagaaaagctccagatcttatgattattttccttggtactaatgatgctggtaatgatgcaaaagttgttgctgaagattattatgaaactttaaagaaattccttactagagttagagaaatttatccagaaacaccacttgcaatcacttcacttttatatgatccaggaaactggaatgaaattcaatctaatattgtaaatgaatttgataatatttactatatctacatcaatgatccagttataaattcatcaccaaatatttacttaactaactaccatcttactcaaaagggtagttgtgctcttatgaaaactatggttgaaaaagttagtcaaca

SEQ ID NO: 26958 - DNA, 606 bp, Neocallimastix californiae
  SGNH_hydro-type_esterase_dom
ggctgttgtctgttttggtgattctattactgatggtagaggtgttactaatgataagaataacagatggactgatattctcgctaccagattacaacagaatccagcaacaaaaaatattggtgtattaaaccaaggtattggtgctactactgtagctggaacttactataatccaactagtccagctggtcaagctagatttgaaaaagatgtcttgaaacaaacaaatgttaaatacttaattatcttatacggtgttaatgatattctctacaataatagtaatgctcaaactatcattaatgtttataaagatttaattaaaaaggctcacaacaatggaattaaggttttcggaggtacaattttaccattcggtaaaaacagtggtttcaactcaaataaggaaagtcaaagaacaactgttaataactggattatgaacacaccagcttctcaaggtggttttgatggttacattgactttgcttcagctgttgctgataaatctaacaaacaatggttgaatactaattggaactttgaaaatgatggtcttcatccaaatgctgttggttatgaagctatgggtaaagctattga

SEQ ID NO: 26959 - DNA, 654 bp, Neocallimastix californiae
  SGNH_hydro-type_esterase_dom
tgatactgttaaaattatgcctgttggtgattctatcacctttggtgaaggtgaaagaggtggatacagaaagtatctttacagtgccttaactcaaaaaggttataaaattgatatggtaggtccggaaggatctaacagtgcttcagctaatggtatacaatatgatgataataatgctggttacagtggattccaaatcaaagaaattccaggctggggtcaacaacaaggtggtgaaggaagtttatataataaacttaagagtaagaatgctgttaagcaatctcaaccagatatcattcttcttatcattggtactaatgatatgactgccaatcgttcaatggatgcttgtgccaatgatcttcgtgctctcttagattatatgcttgcagatatgccagccaatagtattatctttatgggttctattccagaatttactgcttacggtggtaatgctcaaagaattgccaattacaatggtacagttaagaaggttgctgacgaatacgctaataagggtaagaatgttagatttgctgatgttcatggttgtcttaacggtatgtctgatataggtagtgatcgacttcacccaagtggaaatggttacaaaaaaattggtaatttctgggctggagttatcga

SEQ ID NO: 26960 - DNA, 702 bp, Neocallimastix californiae
  SGNH_hydro-type_esterase_dom
taacggtcaaagcagtaataatgaagaagaaagtaaaaattggcctttgtttttagttaaaaaacgtattatgaatatgtggaattttgcttgtagtggagctgtagtagacaatgatattattcatagtaataatgcattgccaatgacagaacaatataaagcttttattttacatatgggtaaaggtggaaaacactcaaattggagaagtgatcagtcattaataggtatctggtttggtatcaatgatataatgaatagagcagataatgatattgattatgatgatgatcaatcaattataaaaagtatgtttaaaataattaataagatttatgatcttggagctcgtaattttttgattttggatgttccatctcttgaaaaacttccacatttcatatacagtcctgtaaagggattagacgaagaagtgttaaaattcaataaaatgattgcggatagtgctatgaattttcaaaaatcaaaaccagaaactaacgtttttgtatataatgcttataatgaattaaattatataatgaaaaatgaaaataaatttggtttcaccattacagttgacgattggtatcataataatgaaagaaaacttgaagatattacaaaagaatatttttggagagatggttatcatctatctaaatatgttcaagaagctttaagccaagaacttgatga

SEQ ID NO: 26961 - DNA, 798 bp, Neocallimastix californiae
  SGNH_hydro-type_esterase_dom
agaatttaaagatattatcatttttggtgattcatatactactgttggtattaacttcaataccatgaaatatactggagataatttatctggaggtaagaattggcctcaattcttaatcgatatgcacccaatgaatatgtggaattttgctattagtggtgctgttgttgacgcaaaagttgttgatggtaatcctcaatatactccaatgactgaacaatataattggttccttaaaaatatggctcctggaaagcaatttagtaattggaaaggtgaatcttctttatttgctatttggtttggtattaatgatattggtagtaaaagacgtaatgaaggtttaactagttctcaaattgatgagaaaattgccacttctatgtttaatatgattgatggtatgtataaacaaggagctagaaacttcatgttcatctttgttcctacaatagaaaaatgtccagcttattctaatggtaataatccaaatatcaaatctgatataccaaattataatagtaatcttaataaatatgcaaaaaatttccaagcttctcatccagatactaatgtctttgtttatgattcctacaatgaatttgattacattatggaaaataagtcacaatatggtattactaacattgatagtacttgtggtggtggatttggttttggttggggttggggcaatcaaaataattgtgattccaacacttacttctggaaggatgtcattcacccaactccaactgttcacaagccattagctcaagatattgaagatttctt

SEQ ID NO: 26962 - DNA, 585 bp, Neocallimastix californiae
  SGNH_hydro-type_esterase_dom
tattggtgattctttaagtgcaggtcaatattgtccaaatgaagctcttgatgcttgggctttcttacttggtaaagctatgaatgttgaagtagatgttatcgctaagccaggtgcatgtttaaccgatgttcctatctatgataatgctcatggattagaatattcctattttatgactaatggaccaaatgctgaacaatttggttatgatgatgatgctgaatatgatttctctaagaggaaggcccctgaacttattattatttatatgggtaataatgatagtggtaaggaagatccaattgctcctgaagattactttgaaactttaaagaaattcattactagaataagaggtatttatccaaattcaaagattattgtcacctcagcttttgatagtagaccacactgggataccgttcaagaacatattccagaatactttgatgatctctactacattccaacctatgaatttggtcttattgaagctccatacgtttatcctcaaaattatcattacactcaattaggtaattgtttattcttaaagaatatcattgaaaagatttctgaggt

SEQ ID NO: 26963 - DNA, 648 bp, Neocallimastix californiae
  SGNH_hydro-type_esterase_dom
tataaaaattatgcctgttggtgattctattacctttggtatgggagaaaatggaggttatagaaaatatctttatagtgctttaactcaaaaaggttataatattgatatggtaggtccagaaggatcaagtagagctacagctaatggtatttcatatgatgataatcacgctggttatagtggattccaaatcaaggaaattcctgattggggtagacaacaaggtggtgatggtagtttatataataaacttaaaagtaaaaatgctgttaaacaagctcaaccagatattattcttcttattattggtactaatgatatgaccgctaatcgttctatggatgcttgtgcctcagatcttcgtgctcttttagattatatgcttggagatatgccatctggtggtattattttcatgggatctattcctgaatttacagcttatggtggtaatgctcaaagagttgcaaattataatggtactgttaaaaaggttgctgaagaatatgctagtaaaggtaaaaatgttagatttgcagatgttcatggtagtcttaatggtactggtgatcttggtggtgatggacttcaccctaatggaaatggttataaaaaaatgggtaacttttgggcagatgttattga

SEQ ID NO: 26964 - DNA, 648 bp, Anaeromyces robustus; identical to SEQ ID NO: 26963
  SGNH_hydro-type_esterase_dom

SEQ ID NO: 26965 - DNA, 780 bp, Anaeromyces robustus
  SGNH_hydro-type_esterase_dom
attaaaagatatagttatttttggtgattcttatacaactgtttctgttgattttgaaactatgacatatactggacttaatttatcagggggtaaaaattggcctcaatttttaattgacatgcatttaatgaaaatgtggaattatgcagttggcggtgcttgtgttgacttaagtttgattaacggtgaccctgaaaatacaccaatgactgaccaatatgcttggttccttaaaaatatgtcaaaaggtaaaaaattcgcaaattgggatggtgatacttcattatttgttatatggtttggtattaatgatattaatggtatgtcaggtattgatgatgtattaaattctggaataaatgaaaaaatagctacctctatatttaatatggttgaaggaatgtataaagaaggtgctaaaaatttcttatttatttatgtaccttctcttgttaaatttccagcttatgccaatgaagatggtactggagtttataatgaaaatctttcttatgttattgatgaagttccagaatataataataatcttaatcaatatgccaaaaatttccaagaaattcatccagatactaatgtttttgtttataatgcttatgatgaatttgattatattatggaaaataaatcagaatatggtattgttaatataagagataaatgttcttatacttgtaatatgaaaacttatttctggaatgataattatcatccaacagctcatgttcataaaatattagcaaaagatattaataccta

SEQ ID NO: 26966 - DNA, 828 bp, Anaeromyces robustus
  SGNH_hydro-type_esterase_dom
gtactctgaatttaaagatttaattatttttggtgattcatatacaactgtcggtattgatttcaatactatgaagtatactggatctaatatgtctggaggtaaaaattggccacaatttttagttgatatgcatccaatgaatatgtggaattttgccattagtggtgctagtgttgatgctaaaattgttggtaatgctcaatttactccaatgactgaacaatacagttatttccaaagaaatatggcagctggtaaacaattttctggttggaaaggtgaaacttccttattctgtatttggtttggtatcaatgatcttggtgctgtaaatcataatggaggtgtaactactgctcaagttagtgaaagaattgctacatcaatgttcaatatgattgaaggtatgtacaaagaaggtggtagaaactttatgtttatttatgttccaccaattgaaaaatgtccagcttacaacagtggtcaaaattatatgaaaactgatgttccaatctataatgatatcattaacaagtatgctcaaaacttccaaaaatctcacccagatactaatatctttgtttacgattcttataatgaatttgattacattatggaaaatagaagtaaatatggtattactaatattgatggtacctgtggaggatttggtttcggtggaggttttggtggaggttttggtggtttcggtggttttggcggtggtaacggtcaacaacaatgtgactctaacacctatttctggaaggatgttattcacccaactccaactgttcataaaccattagctgaagatatgaatga

SEQ ID NO: 26967 - DNA, 792 bp, Piromyces finnis
  SGNH_hydro-type_esterase_dom
atattctgaattcaaagatattgttatctatggtgattcatacactactgtttccaccaactacaacactatggaatacactggtgaaaacttatcaaagggtaagaattggccacaacatttaattgatccaattcacccaatgaagatgtggaattttgctgctaatggtgctgttgttgatgctagaattgttggtcaatacactccaatgactgaacaatattcttacttcttaaaacatatgggtaagggtcaaaaattcaatacctggaagggagaaactacattattcacaatttggtttggtattaacgatcttttaagtaagcgtggtactggtacatctgttgatgaacaaattgctacttctatgtttgaaatgattgaaggtatgtacaatgaaggtggtagaaactttatgatcttcttcgttccagatgttagtaagagtcctctctactatggtaacgaaactcaaaagacttacattccagcatacaatcaaattcttaataagtacgctatgatgtaccaagcttctcacccagatactaacttcttcgtttacaatactttcagtgaatttgaatacattatggaaaacaaatctgaatacggtttaactaacattactgatgtttgtcaaactggttttggtttcggtggtttccaatggggaggtcaaagtaactgtgatgaaaagacttacttctgggctgataaccttcacccaagtccaaaggttcatgaagctttagcttatgatattgataagttcttaagtaccaa

SEQ ID NO: 26968 - DNA, 792 bp, Piromyces finnis; identical to SEQ ID NO: 26967
  SGNH_hydro-type_esterase_dom

SEQ ID NO: 26969 - DNA, 792 bp, Piromyces finnis; identical to SEQ ID NO: 26967
  SGNH_hydro-type_esterase_dom

SEQ ID NO: 26970 - DNA, 102 bp, Neocallimastix californiae
  Six-hairpin glycosidases
tgaagacttccttaatggaggtaatccaccaaccttcagatatcacagattctggggtcaaactgaaatcatggttgccaacggtcttattgccatttacga

SEQ ID NO: 26971 - DNA, 1893 bp, Neocallimastix californiae
  Six-hairpin glycosidases
gaagaagcgtgctgctgatgaatatgctcaacgtgccattgaacattacaatgttgttactggtaatggttcatactcttctgaatatttctcaccagaaaatgttccataccactcaattgaaactatgatggttgaagctccagatcatggtcacgaatctgtctctgaaacttactccttctgggtttggttagaagctgttaacggtaagcttactggtaactatgatggtgttgaaaccgcctggagttacttagaaaagcatcttattccagacagcaagaaccaaccaggtaacagtagatacaatgcttcatctccagctacttacgctccagaagatgatgatattgaaaactatccagctcaacttgtcttccaagatggtattgttggtcaagatccaattgctaaggaacttcaacaagcctatggtacttgggatatctacgccatgcactggattattgatggtgataactggtacggttacggtcaacaaggtgatggtaagtccaagccatccttcattaacactttccaacgtggtgcctctgaatccgcttggaaaactgttccacacccatgttgggaatccatgaagtggggtggtcgtaacggtttcttagatcttttcactggtgataactcttacgctaagcaatggagatacactgctgctccagatgctgatgctcgtgctattcaagctgcttacttcggttacatctgggctgaagaagacggtcaagatctttcttctgttgcttctaaggctgctaagcttggtgattacttacgttactctcactacgataaatacttcaagaagattggtaactgtattgactaccaacgttgtgctgctggttctggtaagaactctgctcactaccttatctcttggtacttcgcctggggtggaggtttacaaggtgactgggcttggagaattagttcttcccacactcacagtggttaccaaaacccattagctgcttggattctttctactgaatctgccttcaagccaaagggttccactgctgttaaggattggtctacttccctcgatcgtcaattagaattattcagatggttacaatctgctgaaggttgtattgctggtggtgccactaactcatggcaaggtcactacgcccaaccaccaagtgacattactaccttctacggtatgtactacgattggcaaccagtttaccacgacccaccatccaacaactggactggtatgcaaggttggggtatggaacgtgtctgttccctttactacctttccggtaacgaaaaggctggtaaggtttgtcaagaatgggctaaatggattaaagcaaacactcgtgttaacggtggtgaagttgtccatgctaccaacttagaatggactggtaacccagatgaatggaagtcctccaacttcaacaagaatggtcttaacgcttcccttcacggtaccgtttcttctgaaggtactgatcttggttccattgcctctatgatcaaggctttaatgtgggtctccttaaaggatggtgatactgaaggtcttcaacttgttcttgatgttatggatgccattgaaaactacaaggatgatcttggttatgctgttgaagaagctcgtgaagattacatcaaattcaacgaagatgtttacattccatctggttggactggtaagaatgctcaaggtgctaacatcagaagtggtgttaagttcattgatattcgtccaaagtacaaggaagatccagattgggctcaagtcgaagacttcctcaacggtggttctgctccaagattcacttaccacagattctggggtcaaaccgaaattatggttgctaacggtcttatctccatttatga

SEQ ID NO: 26972 - DNA, 1875 bp, Neocallimastix californiae
  Six-hairpin glycosidases
tgattacgctgaacgtgctattgaacattacaacaaggttactggtaatggttcctatcaatctgaatatttctctccagaaaatgttccataccactccattgaaactatgatggttgaagctccagatcaaggtcacgaatctgtatctgaaacttactccttctgggtttggttagaagctgttaacggtaaacttactggtaattacgaaggtgttgaaactgcttggagtttcttagaaaagcatcttattccagacagtaagaatcaaccaggtaatagtagatacaatgcttcttctccagctacttacgctccagaagatgatgatattgaaaactatccagctcaacttgtcttccaagatggtattgttggtcaagatccaattgctaaggaacttcaacaagcctatggtacttgggatatctacgccatgcactggattattgatggtgataactggtacggttacggtcaacaaggtgatggtaagactaagccatccttcattaacactttccaacgtggtgcctctgaatccgcttggaaaactgttccacatccatgttgggaaaccatgaagtggggtggtagcaacggtttcttagatcttttcactggtgataactcttacgctaagcaatggagatacactgctgctccagatgctgatgctcgtgctattcaagctgcttacttcggttacatctgggctgaagaagacggtcaagatctttcttctgttgcttctaaggctgctaagcttggtgattacttacgttactctcactacgataaatacttcaagaagattggtaactgtattgactaccaacgttgtgctgctggttctggtaagaactctgctcactaccttatctcttggtacttcgcctggggtggaggtttacaaggtgactgggcttggagaattagttcttcccacactcacagtggttaccaaaacccattagctgcttggattctttctactgaatctgccttcaagccaaagggttccactgctgttaaggattggtctacttccctcgatcgtcaattagaattattcagatggttacaatctgctgaaggttgtattgctggtggtgccactaactcatggcaaggtcactacgcccaaccaccaagtgacattactaccttctacggtatgtactacgattggcaaccagtttaccacgacccaccatccaacaactggactggtatgcaaggttggggtatggaacgtgtctgttccctttactacctttccggtaacgaaaaggctggtaaggtttgtcaagaatgggctaaatggattaagcaaaacactcgtgttaacggtggtgaagttgtccacgctaccaacttagaatggtctggtaacccagatgaatggaatgcttccaactttgacaaatctggtcttaacgcttcccttcacggtaccgtttcttctgaaggtactgatcttggttccattgcctctatgatcaaggctttaatgtgggtctccttaaaggatggtgatactgaaggtcttcaacttgttcttgatgttatggatgccattgaaaactacaaggatgatcttggttatgctgttgaagaagctcgtgaagattacatcaaattcaacgaagaagtttacattccatctggttggtctggtaagaacgctcaaggtgctcaacttaagagtggtatcaaattcattgatattcgtccaaagtacaaggaagatccagattgggctcaagttgaagacttccttaacggtggttctgctccaagattcacttaccacagattctggggtcaaactgaaattatggttgctaacggtcttatctccatctatga

SEQ ID NO: 26973 - DNA, 666 bp, Neocallimastix californiae
  Six-hairpin glycosidases
cgacccaccatccaacaactggactggtatgcaaggttggggtatggaacgtgtctgttccctttactacctttccggtaacgaaaaggctggtaaggtttgtcaagaatgggctaaatggattaagaaaaacactcgtgttaacggtggtgaaattgtccatgctaccaacttagcctggactggtaacccagatgaatggaagtcctccaacttcaacaagagtggtcttaacgcctcccttcacggtaccgtttcttctgaaggtactgatcttggttccattgcctctatgatcaaggctttaatgtgggtctccttaaaggatgaagatactgaaggtcttcaacttgttcttgatgttatggatgctatggaaaactacagggatgatcttggttatgcagttgaagaagctcgtgaagattacattaaattcaacgaagatgtttacattccatctggttggactggtaagaatgctcaaggtgccaacatcagaagtggtgttaagttcattgatattcgtccaaagtacaaggaagatccagattgggctcaagtcgaagacttcctcaacggtggttccgctccaagattcacttaccacagattctggggacaaactgaaattatggttgctaacggtcttatctctatttacga

SEQ ID NO: 26974 - DNA, 1086 bp, Neocallimastix californiae
  Six-hairpin glycosidases
ctctcactacgataaatacttcaagaagattggtaactgtattgactaccaacgttgtgctgctggttctggtaagaactctgctcactaccttatctcttggtacttcgcctggggtggaggtttacaaggtgactgggcttggagaattagttcttcccacactcacagtggttaccaaaacccattagctgcttggattctttctactgaatctgccttcaagccaaagggttccactgctgttaaggattggtctacttccctcgatcgtcaattagaattattcagatggttacaatctgctgaaggttgtattgctggtggtgccactaactcatggcaaggtcactacgcccaaccaccaagtgatattacctccttctacggtatgtactatgattggcaaccagtttaccacgacccaccatccaacaactggactggtatgcaaggttggggtatggaacgtgtctgttccctttactacctttccggtaacgaaaaggctggtaaggtttgtcaagaatgggctaaatggattaaagaaaccactcgtgttaacggtggtgaaattgtccatgctactaacttagaatggtctggtaatccagatgaatggaaatcttctaactttaacaagtccggtcttaatgcctcacttcatggtactgtttcttctgaaggtactgatcttggttctattgcctctattatcaagggtttgatgtgggtttctatgaaggatggagatgaagaaggtctccgacttgttcttgatgtcatggatgctattgaaaactacaaggatgaccttggttatgctgttgaagaggctcgtgaagattacatcaagttcaatgaagaagtatacattccatcgggatggtcaggtaagaacgctcaaggtgccaatattaagagtggagtcaagttcattgatattcgtccaaagtacaaggaagataaggattgggctcaagtggaagacttccttaatggaggatcggctccaagatttacttaccacagattctggggacaaactgaaattatggttgctaatggtcttatctctatctatga

SEQ ID NO: 26975 - DNA, 681 bp, Neocallimastix californiae
  Six-hairpin glycosidases
gcaaccagtttaccacgacccaccatccaacaactggactggtatgcaaggttggggtatggaacgtgtctgttccctttactacctttccggtaacgaaaaggctggtaaggtttgtcaagaatgggctaaatggattaagaaaaacactcgtgttaacggtggtgaaattgtccatgctaccaacttagcctggactggtaacccagatgaatggaagtcctccaacttcaacaagagtggtcttaacgcctcccttcacggtaccgtttcttctgaaggtactgatcttggttccattgcctctatgatcaaggctttaatgtgggtctccttaaaggatgaagatactgaaggtcttcaacttgttcttgatgttatggatgctatggaaaactacagggatgatcttggttatgcagttgaagaagctcgtgaagattacatcaaattcaacgaagatgtttacattccatctggttggactggtaagaatgctcaaggtgctaacatcagaagtggtgttaagttcattgatattcgtccaaagtacaaggaagatccagattgggctcaagtcgaagacttcctcaacggtggttctgctccaagattcacttaccacagattctggggacaaactgaaattatggttgctaacggtcttatctctatttacga

SEQ ID NO: 26976 - DNA, 102 bp, Neocallimastix californiae; identical to SEQ ID NO: 26970
  Six-hairpin glycosidases

SEQ ID NO: 26977 - DNA, 1338 bp, Neocallimastix californiae
  Six-hairpin glycosidases
tcaagattatgctagacacattgaattatctcttcttttctacgaagctcaacgttctggtaaacttccagaagacaacagaatttactggagacatgatagtgaacttgaagctggtgctgatcatggtgttgatcttactggtggatattacgatgctggtgataatgctaagtttaatttcccagctgcttctactatgactcttttagcttggagtggtattgattatgctgaaggttacaaaaatgctggtcaatggaaatatattttagatgctgttcgttggggtgctgactactttattaaatgtcacactggtaaaactgaactttatgctcaagttggtgatggtaacactgatcattctttctggtatccaccagaatatgttcaatatgattacccatcattcaaagttactgctcaagaaccaggttctgaagtagctggtgaaacagctgctttcttagctgctgcatctattcttttcaaagatgaagatccatcatattctgctactttattaaagcactcaaaggaaatttatgacttcgctgataaatatcgtggtgattacactgttgctgttccagctgtcagtttttataacacttacagtggttatatggatgaattagcttggggtgccgcttggcttcttagagctactggtgatgaatcatatcttgataagtacaatgtcattgccaataaaaagtatgaatcttatgatccaaagaaattcactggtgctactggaccaatctcttgggatgataaaagacctggttgttatattttaatggctatgattactggtgatgaaaagcgtattaatgaagcttacagttactgtgatgccgttttaactcaaccacgtaccaaaggtggtttatggtatgatgatggtttatctatttggggttctaaccgttacgcttctaatgctgcatcaatgcttggtatgtttgcaaattatcttccaaagtctgacccaaagcgtgcaaaatatgttgaattcgttaaacaacaaactgattatattcttggtgataacccagctaagattaattatgttgttggtgctgaagccaattcaccaaaagctgttcaccaccgtggtgcttctggtgtatttgattctcaagataaggctgctaagccagatgaaaacatatatactttatggggtgctttagctggtggtccagataagaatgataagttcgttgatagccgtaaggactatcaaatgagtgaagttgctcttgattacaatgccgctttccaaatgaatcttgcattccttactaaggaaggtttaagtaaaccaga

SEQ ID NO: 26978 - DNA, 1341 bp, Neocallimastix californiae
  Six-hairpin glycosidases
tcaagattatgctagacacattgaattatcacttcttttctatgaagctcaacgttctggtaaacttccagaaaataatagaatttactggagacatgatagtttactcgatgctggtgctgataacaaggtcgatcttactggtggttattatgatgctggtgataatgtaaagtttaacttcccagctgctgctgccttaactcttcttgcatggagtggtattgactatgccgatggttataagaaagctggtcaatgggattaccttttagatgctgttaaatggggtgctgactatttccttaaatgtcacactggtaagaacgaactttatgttcaagttggtaagggtgcaactgatcatggtttttggtatccaccagaatatgttcaatacgaatatccatcctacaaaattacttcttctgcaccaggtagtgaagttgctggtgatactgcttcattcttagcagcatcttctattcttttcaaagatgttgattcatcttactcagccactttattaaagcacgctaaagaaatttatgattttgctgatacctatcgtggtgaatacattaaagctgttccagatgcccaaggattttactctaactggagtggttgtgatgatgaattagcttttggtgctttatggttatatagagctactaaagatgaaagttacatgaataagtttaagaaaattgctgatgcctcttatggtgaacaagatactaaagcttatggtacttgttctggaccaatttcatgggatgataagagaccaggtgcttatattttagctgctatgcttactggtgatgaaaagcgtaagagtaaagcttacagttactgtgatgctattttaactcaaccaaagactccaggaggtttatggtatgatgctaacctttctaagtggggttctaaccgttatgcttctaacgctgcagctatggttgctatgtttgccaattctcttccagcttctgattctaaacgttctaagtacgttgacttcgttcaaaagcaaactgattatattcttggtaataatccagcaaaggtaaactatgttgttggtgctgaagctaactctccaaaggctgttcaccatcgtgctgcttctggtacttatgattctcaagataaaaatgctaaaccaactgactacaatgtcttcactttatggggtgctttagctggtggtccaggttcaaaggatgaatacactgataccagaaagaactatgaaatgaatgaagttgctcttgattacaatgctgctttccaaatgaatcttgctttccttactaaggaaggtttaagtaagcc

SEQ ID NO: 26979 - DNA, 1329 bp, Neocallimastix californiae
  Six-hairpin glycosidases
acaagattatgctagacatattgaactttctttacttttctatgaagctcaacgttccggtaaacttccagaaaataaccgtatttactggagacatgatagtatgcttgatgccggtgctgataatggtgttgatcttactggtggttattatgatgctggtgataacgtaaagtttaatttcccagctgctgctgccttaactcttttagcttggagtggtgttgactatgctgatggttacaagaaagctggtcaatgggattatcttcttgatgctgttcgttggggtgctgactatttcataaaatgtcacactggcaaaaatgaactttatgctcaagttggtaggggtactaccgatcatggttactggtaccctccagaatatattcaatatgatcatccttcctacaaggttacagcttcatctccaggttctgaagtcgctggtgataccgcttcattcttagctgctacttcaattttattcaaggatgaagatccatcttattctaagaaatgtttacaacatgccactgaaatctatgatttcgctgatacctatcgtggtgattacactggttctattccagatgtttctggtttctactctacttggagtggttacaatgatgaattagcttttggtgccttatggctttacagagctactggtgatgaatcttactatgaaaaatttaagaaaattgctgatgccgaatatggtgcccaagattccaaggcttatggtacctgtactggtccaatttcttgggatgataaaagaccaggtgcttacgttcttgctgccatcattactggtgatgaagatcgtttaaagcaagcctactggtattgtgataatgttttaactcaaccaagaactaaaggtggtttatggtatgattctaatctttcaaagtgggcttctaaccgttacgcttctaatgctgctgctatgttagctatgatggctaattaccttccaaagggcgatgccagacgtgctaaatacgttgattttgtaaagagtcaaaccgattatattcttggtgataatccagctggtgttaactttgttgttggtgctgaagccaattcaccaaaggcagttcaccaccgtggtgcttccggtacctatgattcacaagatgtccatgccagaccaaccgattacaatatcttcactttatggggtgctttagctggtggtccaagtaaggatgatacctactctgataccagaaaggattatgaaatgaacgaagttgctcttgattacaatgctgccttccaaactaatcttgctttccttgttaaggaagg

SEQ ID NO: 26980 - DNA, 510 bp, Neocallimastix californiae
  Six-hairpin glycosidases
cgctttaatgtatatggttactggtgaagacaaatacaaggaacaagctttcaatcacagtgatcttatggtcaactacaaaactactccaggtggtttatggttcgatactaatctttctgcttggggttctaaccgttatgctagtaacgctgcttataccgttgctatggttgcttctactatggatgccagtgacgctaagcgtaagcaatacgttaaatttattcagaagcaaatcgattatattcaaggagataatccagctaaggttgattatgttgttggtgctgatccaagttcaccaaaatctgttcaccaccgtggttcttctggtactatgaatgctatggctgaaccacctttcaatgttttcccactttatggtgctcttgctggtggtccagatggtaatgataagtacactgatgatcgtactaactataactctaatgaagttgctttagattataatgccgcttatactggtcttcttgctttcttaattca

SEQ ID NO: 26981 - DNA, 1077 bp, Neocallimastix californiae
  Six-hairpin glycosidases
ttacttaggtaagactgatgaagaaattcaaaagaagttagatcaactttggaatcattactttaagggtaacaacaacagtaaagtattttatgaccaaggaaatgaaggttatattttagatgttaacaacaatgatgttcgttccgaaggtatgtcttatggtatgatgatctgtgtacaaactgatcacagagaagaatttgacaagatttggaattgggcaaagaaccacatgtggcataagagtggtagctgggatggttacttcgcttggaaaagaggatcaaatggttatggtggtgatgataattgtgcaccagatggtgaaatgtatttcatgatgtctcttctctttgctgctaaccgttggaataacaagcaatacatggatgatgctcaatacattttaaagagaatgtgggataacagccaacactctcttttcaacccaagatataatgttattaccttccaaccacaaggtaatgaaaataatttctctgatccatcttacgatttaccagcctttgttgatctcttctctcgttggtcaacaactaatcaaggcaaatggaaggccgctgcttctgctactcgtgaccatttatacaaatcttcaaacactaagtctggtttattcagtgattacaacaactttgatggtactccacattctgtaagttataacagtaatgctcaaaagtatatgtacgatgccatgcgttgtgctatgaactttggtatggattattatctctttggtgctgatgctaagcgtcaaactgaaatggctagacgtcttattgacttctttgaaaaagatggttaccaacatgctcgtttcaactgggatggttcaaacccatctgaacaatatactttaggtgaagttggtgctaatgcagttgctacctacgctttaatgggtgttaatggatacgaagacattattaagaagaacttaaagatggcttgggatggtgaaccaatgactggtcaataccgttactacgatggtttagtccactacttatctatgcttcatcttactggtagtttcaaaatctggaaacc

SEQ ID NO: 26982 - DNA, 1884 bp, Neocallimastix californiae
  Six-hairpin glycosidases
tgcttccgatgaatacggtaatcgtgttactgaactttacaacaaagtaactggtaatggttcttacagttctgaatatttctcagctgaaaaggttccatatcactccgttgaaactcttatggttgaagctccagatcatggtcatgaatctgtatctgaaactttctctttctggatttggttagaagccgttaatggtaagattaccggtaactacgatggtgttgaagaagcttggagttacttagaaaagcacattattccagatagcaagaaccaaccaggtaacagtagatacaatccatcttctccagctacttatgctgctgaacatgatgatattgatggttatccatcacaacttgtcttccaagatggtattgttggagaagatccaattgctaaggaacttcaacaagcctatggtaattgggatatttacattatgcactggatcattgatggtgataactggtatggatatggtcaacaaggagatggtaagactaagccatctttcattaacaccttccaacgtggtccttccgaatctacttggaagactgttccacatccatgttgggaatccatgaagtggggtggttctaacggtttcttagatcttttcaccattgataattcctacgccaaacaatggagatacactgcagctccagatgctgatgctcgtgccattcaagctgcttacttcgcttacatttgggctgaagaagatggagttaatctttcatctgttgcttctaaagctgctaagcttggtgattacttacgttatgctcaatacgataagtacttcaagaaggtaggtaactgtgttggttatcaacaatgtcaagctggtcgtggtaagaattcagctcactatcttatttcatggtacttcgcttggggtggaggtttacaaggagattgggcttggagaattggttcatctcacactcacactggttaccaaaatccattagccgcttgggttctttctactcaatctgctttcaagccaaagtcttctactggtgctaaggattgggctacttctcttgaccgtcaattagaattattcagatggttacaatcagctgaaggttgtattgctggtggagccactaactcatggcaaggttcttatgctcaaccatccagtgatatcacatccttctatggtatgtggtatgattggcaaccagtttaccacgatccaccatccaacaactggactggtatgcaaggttggggtatggaacgtgtttgttctctctactacctttctggtaatgaaaaggctggaaagatttgtcaagaatgggccaaatgggttaagaacactactcgtgtcagtggtggtgaagttgtccatgctactaacttagaatggtcaggtaatccagatgaatggaattcttccaacttcaacaaatctaaccttaaccgttccctacacggtactgtttcttctgatggtattgatattggtaccattgcttctattatcaagggattaatgtgggtttctatgaaggatggagatcaagaaggtattaatctttctattgatgttatggatgctattgaaaattacaaggatgatcttggttatggtactaccgaagctcgtggtgattacgataaattcggaggagaagtttacattccaagaggatggagtggtaagaatgctcaaggtgctaacattagaaatggagttactttcattgatattcgtccaaaatataagcaagatccagattgggaacaagttgaagcttaccttaatggaggagaaccaccagtattcacttatcacagattctgggctcaaactgaaattgctgttgctaatggtcttatttctatttatga

SEQ ID NO: 26983 - DNA, 1314 bp, Neocallimastix californiae
  Six-hairpin glycosidases
tcatactcgtgattacgctagaattttgaacttaaatttacgtttttatgaatgtaattggtctggtaaagctccagaacataaacaagtctattggagatatgattctgctttagaagatggagctgatgttggtttagatcttactggaggttattatgatgccggtgaccatgttaaatttaatttaccaatgtcttatgcaatgactatgttagcatggggtggtattgatttatatgataattatgttgcagctggtcaaattgattatttagttcaaattgtcaaccatggtgcagattattttgtaaagtgccatccagaaaaagaagtcatttatgcacaagttggtcttggtgatgttgaccattgtttctgggtaccaccagaattaatgactatggaaagaccagctgtttgtaaacttactccagaaaatggtgcttctgatgttactgctcaaatggcagctgctttagctagtgcctcaattttaaataagatggtaggaaatactgaaaagtctgaactttatttaaagcatgccattgaaatttatgactttgctgataaatatagagatgtttatggtaatccatgtccagaaggtgcttccttttatccatctgcatcttataaggatgaattagtttggggtgctgcatgggtttatcgtgcttctggagatgaaaaatactatgaaaaggctgattcttattacgattcacttggattatctggtcgtgttttaattggtccaatttcatgggatgatgcttcatcaggtattattttcttaatgtcaaagcctggttttggttctaattggaagagatatttaggtgaagctcaaacatacgttgatcaatatttaaatgataagagtgctcgtacagatgctggtatgttatggtatagtgctgtttctggttggggatctgctcgtcatgctatggctggtgtattcctttattgtattttcaatacttaccataaaccaactgatccaaaatactttaatttcattcaacaacaagccgattatattcttggtaataatccatttaatcgttcacttgttgttggttcaattccaggacatgatccattaaatgttcatcatcgtggttcccatggtggttattctccaatttcattaccagaacataatatgtacacattatatggtgcacttgctggtggtccacttcaagatgattcatgggatgatgatagaaataattatattactaatgaagtttcatgtgattataatgctggtgttactggtgttatggcataccttacccc

SEQ ID NO: 26984 - DNA, 1893 bp, Neocallimastix californiae
  Six-hairpin glycosidases
aagaaagcgtgctaatgatgaatatgcacaacgtgctattaacacatataatactgttactggtaatggttcatacaaatcaagttatttctcaccagaagttgttccataccactctattgaaactcttatggttgaagctccagatcaaggtcacgaatctgtatctgaaactttttctttctgggtttggttagaagccgttaatggtaaacttacaggtgattactcgggtgttgaaaaagcatggtcttacctagaaaagcacatgattccagatagtaagaatcaaccaggtatgagtagatacaatccatcctcaccagctacttatgctccagaagatgatgatattacgaactacccagctagacttgtcttccaagatggtattgtcggtcaggatccaattgctcaggaacttcaacaagcttatggtacttgggatatttatgctatgcactggattattgatggtgataactggtatggatatggtcaacaaggtgatggtacatctaagccatctttcattaacactttccaacgtggtgcttccgaatctgcttggaagactgttccacatccatgttgggaaacattcaagtggggtggttcaaatggtttcttagatcttttcactttagataacaattactctaagcaatggagatacactgatgcaccagatgctgatgctcgtgctattcaaggtgcttactttgcttggctttgggctaaggaggatggtaaaaacctttcatcccttgcttctaaggctgctaagcttggtgattacttacgttactctcactatgataagtatttcaagaagattggtaactgtgttggctatcaacaatgtcaagctggatctggtaagaattcagctcactaccttatttcatggtacttctcatggggtggtggtttacaaggtgattggtcttggagaattggttcttctcacactcacagtggttaccaatctccattagctgcatggattctttctactgaatctgctttcaaaccaaagtctgcttctggtgctaaggattgggctacttctttagaacgtcaaatagaattattcagatggttacaaacttctgaaggttgtattgctggtggtgccaccaattcatggcaaggtcattacgctcaaccagatagctcaattacttccttctacggtatgtggtacgattggcaaccagtttaccacgacccaccatccaataactggactggtatgcaaggttggggtatggaacgtacttgttgttactattacctttctggtgatgaaaaagctggtcttgtttgtcagaactgggctaaatgggttaaggcaaatactcgtgttagtggtggtcaaattgttcatgctactaacctttcctgggaaggtagtccagatgaatggaattcttcaaacttcaacaaggctaatcttaacgcttcccttcatggtactgtttctgctgaaggtattgatcttggttcaattgcctcaattattaagggtttgatgtgggtctccatgaaggataatgatcaagaaggtattaaccttgttattgatgttatggatgctattgaaaactacaaggatgacgaaggttactgtgctgatgaagctcgtgaagactatgccaagttctcatctgaagtttacattccatctggatggtctggtaagaacgctcaaggtgcaaacattaagaatggtgttactttcattgatattcgtccaaaatacaaacaagatcctgattgggcacaagttgaaaacttcattaatggaggagaaccaccaagattccgttaccacagattctggggtcaaactgaaattatggttgccaatggtcttatttctatttatgg

SEQ ID NO: 26985 - DNA, 1887 bp, Neocallimastix californiae
  Six-hairpin glycosidases
taaatatgatgaatatagtcaacgtgctattgaacactataatattgttactggtaatggttcatatcaatctgaatatttctctccagaaaatgttccataccactcaattgaaactatgatggttgaagctccagatcatggtcatgaatctgtatctgaaacttactccttctgggtttggttagaagcagttcatggtaaacttactggtaactatgatggagtttccactgcttggagttacttagaaaagcatcttattccagatagtaagaatcaaccaggtaacagtagatacaatgcttcttctccagctacttatgctccagaagatgatgacattgaaaactatccagctcaacttgtcttccaagatggtattgttggtcaagatccaattgctaaggaacttcaacaagcttatggtacttgggatatctatgctatgcactggattattgatggtgataactggtatggttatggtcaacaaggtgatggtaagtctaagccatctttcattaacaccttccaacgtggtgcctctgaatcagcatggaagactgttccacacccatgttgggaaactatgaagtggggtggtcctaacggtttcttagatcttttcactggtgataactcctatgctaagcaatggagatacactgctgctccagatgctgatgctcgtgctattcaagctgcctactttggttatatttgggctaaagaagatggagttgatctttcttctgttgcttcaaaggctgctaagcttggtgattacttacgttactcacactacgataaatactttaagaagattggtaactgtattgattatcaacgttgtgctgctggtagcggtaagaactctgctcactaccttatctcatggtactttgcctggggtggaggtattcaaggtgactggtcatggagaattggttcttcccacacccacagtggttaccaaaatccattagctgcttgggttctttcaactgaatcagcctttaaaccaaagggatctactgccgtcaaggattggtcaacctctttagatcgtcaattagaattattcagatggttacaatctgctgaaggttgtattgctggtggagccaccaactcatggcaaggtcactatgctcaaccagatagtgatattaccactttctatggtatgttctacgactggcaaccagtttaccacgatccaccatccaacaattggactggtatgcaaggttggggtatggaacgtgtctgttccctttactacctttctggtaacgaaaaggctggaaagatttgtcaagaatgggctaagtgggttaaggaaaacactcgtgttattggtggtgaagttgttcatgccactaacttagaatggacaggtaatccagatgaatggaaatcttcaaactttaacaagaatggtcttaactctcaacttcatggtactgtttcttctgaaggtactgatcttggttcaattgcttctatcattaaggctttaatgtgggtttccttaaaggatgaagattctgaaggtctccgacttgttattgatgtaatggatgctattgaaaactacagagacgatcttggttacgctgttgaagaagctcgtgaagattacaataagttcgaagaaaatgtttacattccttcaggttggactggtaagaacgctcaaggtgctaacatcagaagtggtgttaagttcattgatattcgtccaaaatacaagcaagataaggattgggctcaagttgaagactaccttaacggtggtaaccctccaaaattcacttatcacagattctggggacaaacagaaattatggttgccaatggtcttatttctatctatgatgt

SEQ ID NO: 26986 - DNA, 687 bp, Neocallimastix californiae
  Six-hairpin glycosidases
cgactggcaaccagtttaccacgatccaccatccaacaattggactggtatgcaaggttggggtatggaacgtgtctgttccctttactacctttctggtaacgaaaaggctggaaaggtttgtcaagaatgggctaagtgggttaagaaaaacactcgtgttaatggtggtgaagttgttcatgccactaacttagaatggacaggtaatccagatgaatggaaatcttcaaactttaacaagaatggtcttaactctcaacttcatggtactgtttcttctgaaggtactgatcttggttcaattgcttctatcattaaggctttaatgtgggtttccttaaaggatgaagattctgaaggtctccgacttgttattgatgtaatggatgctattgaaaactacagagacgatcttggttacgctgttgaagaagctcgtgaagattacattaagttcaatgaagatgtttacattccttcaggttggactggtaagaacgctcaaggtgctaacatcagaagtggtgttaagttcattgatattcgtccaaaatacaagcaagataaggattgggctcaagttgaagacttccttaacggtggtagcgctccaagattcacttaccacagattctggggacaaacagaaattatggttgccaatggtcttatttctatctatga

SEQ ID NO: 26987 - DNA, 1887 bp, Neocallimastix californiae
  Six-hairpin glycosidases
gcgtgcttctgatgaatatgctcaaagagttattgatacttacaatgccgttactggtaatggaagttacaattctgattacttctcaccagaaaatgttccataccactcaattgaaaccatgatggttgaagctccagattacggtcatgaatctgtttctgaaacttattccttctgggtttggttagaagctattaatggtaagatgactggtgattacaagggtgttgaaactgcttggagtttcttagagaagcatcttattccaaatagtaagaatcaaccaggtatgagtagatataatacttcttctccagctacttatgccccagaagatgatgatattactaactatccagctcgtcttgttttccaagacggtattgttggtgaagatccaatcgctaaagaacttcaacaagcctatggtacttgggatatctacgctatgcactggatcattgatggtgataactggtatggttatggtcaaaatggtgatggtacctctaagccatccttcattaatactttccaacgtggtgcctctgaatccgcttggaaaactgttccacacccatgttgggaagaaatgaaatggggtggtcgtaatggtttcttagatcttttcactggtgataacagttactctaaacaatggagatacactgctgctccagatgctgattctcgtgctattcaagctgcttactttgcttacatctgggctaaagaagatggtcaaaatctttcctcccttgcttctaaggctgctaagcttggtgattacttacgttacgcccaatacgataaatacttcaagaagattggtaactgtatcggctatcaacaatgtcaagctggtcgtggcaaaaactctgctcactaccttatttcttggtacttctcttggggtggtggtctccaaggtgattggtcatggagaattggttcctctcacactcacaccggttaccaaaacccattagccgcctggattctttctactcaatctgctttcaagccaaagggttccactgctgttaaggattggacgacttccttagatcgtcaattagaattattcagatggttacaagctgccgaaggttgtattgctggtggtgccactaactcatggcaaggtcactacgctcaaccaccaagtgaaattacttccttctacggtatgtactacgattggcaaccagtttaccacgatccaccatccaacaactggactggtatgcaaggttggggtatggaacgtgtctgttctctttactacctttctggtaacgaaaaggctggaaaggtttgtcaagaatgggctaaatgggtcaagaacaatgttcgtgtcaacggtagcgaaattgttcatgccactaacttcgaatggtccggtaacccagatgaatggaaggcctccaactttaacaaatctggtcttaacgcttcccttcacggtgccgtttcctctgaaggtattgatcttggttctatcgcctctatcattaagggtttaatgtgggtttccatgaaggataatgatcaagaaggtattgatctttccgttcaagttatggatgccattgaacaatacaaggatcaatatggttatggagttgaagaagctcgtgaagattacattaagtttaatgaagaagtttacattccaagtggttggactggtaagaatgctcaaggtgctaacatcagaaatggtgtgaagttcattgatattcgtccaaagtataaggaagatccagactgggctcaagttgaaaacttccttaacggtggtgaagctccaagattcacttaccacagattctgggctcaaactgaaattgctgttgctaatggtcttatctctatttatgg

SEQ ID NO: 26988 - DNA, 1125 bp, Neocallimastix californiae
  Six-hairpin glycosidases
taaagaaatgttcaaaggaacttggaactacattgatggtgttttcttaaatagtgttataaacttatataaaaagactaataatgaaaagtacaaagatttcttcatcaaatatgttaactactatgtttctgaagatggtacttttgttcattacactgctgatggagtaaagaccgtcgataatgaaatgggttgggttaatggtgaacttgataccgtttgtgaaagtaagattttatttgatgcctatgaaatgactggtgataaaagataccttactgcaattgaattcacctacaagaagcttatggaaatgccatactgttataattctccaaacttctggcataagaccttctatatcaatcaaatctggcttgatggtatgtatatgtacgctcctttcttagctagatatgctcttttaaaaaatgatctttcaattttagatgatattaagaaccaatacgctttcattcatgataatatgagagatgaaaatggtttataccaccatggtttcgatactaccaagactattttctggagtaaaaataatgatggtaagagtgaaaacttctggcttagaagtatgggttggtttgcagtttctcttgctgatatcttagaatattacccagaaggtgaaaacaaagaatacttaaagagtatcttagaagaattattaaatggtatattaccataccaagataagactactaagatgttctaccaagttattgatagaccagaagaaattcaattagttgacaaattttatttcagtaatcttaaaaactctaaatacggtaatattaatacctttgtttctaactatgttgaatctagtggatcttctatgcttgcttattctttcttaaaatatggtaaagtttaccagaatggtggtaactttgaagaaattggaaaagaaatatttgaagctgtttacaagcattcttacaagaacaacaccttatctgatatctgtattactgccggtcttggtccagaagttaagacttaccgtgatggtactttatcttactaccttgctgaagtagttggtgatgatgatgcaaaaggtgttggtccattcattatggctttcattgaatacaa

SEQ ID NO: 26989 - DNA, 1122 bp, Neocallimastix californiae
  Six-hairpin glycosidases
ggaaagtttcaagggaaagtggaactacattgatggtgttttcttaaatagtgttgttaatttatataagaagactaataatgaaaagtacaaagaatttttcattaaatatattaattactatgttgcagaagatggtactttcgttcattacactgaagacggtgtaaagactgtcgataatgatttaggttgggttactggagaacttgatactgtttgtgaaagtaagattttattcgatgcttatgaaatgacaggtgataaaagatacctcactgctattgaatttacttaccaaaagcttatggaaatgccattatgttacaattcaccaaatttctggcataagactttctacatcaatcaaatttggcttgatggtatgtatatgtacgctccattcttagctagatatgctgttttaaagaatgatctttctattttagataatatcaaagaacaatatgctttcattcatgataacatgagagacgaaaacggtttataccatcatggtttcgataccactaaaactattttctggagtaaaaataatgatggtaagagtgaaaacttctggcttagaagtatgggttggtttgctgtatctcttgctgatatcctagaatactacccagaaggtgaaaataaagaatatttaaaaaatgttttagaagaattattaaatggtatattaccattccaagataaaactactaaaatgttctaccaagttattgacaaaccagaagaaattcaattagttgacaaattctatttcagtaatcttggtaattctaaatatggtgatattaatacttttgtttctaactatgttgaatctagtggttcttctatgtttgcatactccttcttaaagtatggaaaggtctatcaaaatggaggaaaatttgaagatattggtaaagaaatctttgaagctgtttatcaacactcctaccaaaaccacactttatccgacatttgtattactgctggtcttggtccagaagctaagacttatcgtgatggtactttatcatactatcttgctgaaaaagttggtgaagatgatgctaagggtgttggtccattccttatggctttcattgaatacaa

SEQ ID NO: 26990 - DNA, 1461 bp, Neocallimastix californiae
  Six-hairpin glycosidases
tgtttctggtgatgctgctaagaaggctgaagccgctctcagtaaagttaagaatgttgattattctaccttaaagagtaaacacattgaagcttacaagaagcaattcgatcgtgtaaagatctctcttccaacaagtagtgcttctgccgatcaaactgtcaatagaattcttaacttcaatagatctgatgatcaagatcttgtcgctttaatgttccaatacggtcgttacctcttgataacttcttctcaaccaggtggtcaagcagctaaccttcaaggtatttggaatgattccactgatgctccatgggatagtaaatacacaatcaatatcaatgcccaaatgaattactggccagctgaagttactaacctcagtgaatgtcatgaaccaatgtttgatctcattcgtgatctttccgttactggtaaggaagctgcctccaaaatctacggtgctgaaggttggatggctcaccacaacacagatatctggcgtgttaccggtccaattgatggtgccttctggggaatgtggccaaacggtggtggatggttatctactcacatctggcaacattaccttttcactggtgacaaagacttccttaagaacaactatgccatcttaagagatagtgctaagttctatgttacaagtatgcaaaaggatccaaacaccggattcttggttactgtaccatccacttctccagaacatggttattcttcagatggttcatccatgaccgctggttgtactatggataaccaaattgctttcgatgtcttgaaccaagctcttcttgctgctcaaacccttggtgttgatgaaagcttccaatccaccttaaagagtaccatgaacaatattgctccaatgaaggttggtcaatacaatcaattacaagagtggtttgttgatgctgataatccaagagatgatcatcgtcatgtatctcacctttacggtctctacccaagtggtcaaatttctccattcaagcaaccacttttatttgaagctgctaagaatacccttaatcaacgtggtgatatggctaccggttggagtattggttggaagattaacctttgggctagacttttagatggtaaccatgcctataaaattattcaaaatatgattaatcttgttcgtgataacgatggaggtaatggtagagtctataccaatctttttgatgctcacccaccattccaaattgatggtaactttggtttctgtgctggtattgctgaaatgcttttacaaagtcatgatggtgctgttcatctccttccagccttaccaaatgtttggaaagaaggtagtgttagtggtttagttgctcgtggtggttttgaagtcagtatggattggaagaatggtaaaattagtaaggccactattaaatctaagattggtggttccttacgtattcgtagtaatac

SEQ ID NO: 26991 - DNA, 1884 bp, Neocallimastix californiae
  Six-hairpin glycosidases
tgctagtgataagtatgctcaacgtgttattgatacttacaatgctgttactggtaacggtaactataactctgaatatttctcaccagagaatgttccataccactctgttgaaaccatgatggttgaagctccagattatggtcatgaatccgtttctgaaacttattccttctgggtttggttagaagctattaatggtaagatgaccggtgattacaaaggagttgaaactgcttggagttacttagaaaaacatcttattccagacagtagaaatcaaccaggtatgagtagatataacagctcttctccagccacttacgctccagaagatgatgatattgaaaactacccagctcgacttatcttccaagatggaattgtcggtgaagatcctcttgctagagaacttcaacaagcttatggtacttgggatatatatgctatgcattggattattgatggtgataactggtacggttatggtcaacaaggtgatggtagaagtaagccatccttcattaacaccttccaacgtggtgcttcagaatctgcttggaagactgttccacacccatgttgggaaaccatgaaatggggtggtagaaacggtttcttagatcttttcactggtgataacagttactccaagcaatggagatacactgctgctccagatgctgatgctcgtgctattcaagctgcttacttcgcctacatttgggctaaggaagacggtacaaatcttagttctcttgcttctaaagctgctaaacttggtgattacttacgttactctcattatgataaatatttcaaaaaaattggtaactgtattggatatcaacaatgtcaagctggtcgtggtaagaattctgctcactatcttatttcttggtacttctcttggggtggtggtttacaaggtgattggtcttggagaattggttcttctcacactcacactggttaccaaaatccattagctgcttgggttctttctactgaatctgccttcaaaccaaagagttccactgctgttaaggattgggctacttctatggaccgtcaattagaattattcagatggttacaagcttctgaaggttgtattgcaggtggtgccacaaattcatggcaaggtcattacgctgaaccaccaagtgatataactaccttctatggtatgtactatgactggcaaccagtttaccacgatccaccatctaacaactggactggtatgcaaggttggggtatggaacgtgtctgttccctttactacctttctggtaatgaaaaggccggaaaggtttgccaagaatgggctaagtgggttaagaagaatgttcgtgttaatggtaatgaaattactcatgctactaacttctcctggtccggtaaccctgacgaatggaatccaagtaatttcaataaatctggtcttaatgcttcccttcatggtactgtttcttctgaaggtattgatattggttcccttgcctctattattaagggtttaatgtgggtttctatgaaggataaagatcaagaaggtattaacctttctataaaggttatggatgctattgaaaactatagagatgatcttggttattcagtcgaagaagctcgtgaagattacatcaaattcaatgaagaagtttacattccatacggatggactggtaagaatgctcaaggtgccacccttgaacatggtgttaagtttattgatattcgtccaaaatacaaacaagataaggattgggcacaagttgaaaacttccttaatggtggtgaagccccaagattcacctaccacagattctgggctcaaactgaaatcgctgttgctaatggtcttatttctatctataa

SEQ ID NO: 26992 - DNA, 1323 bp, Neocallimastix californiae
  Six-hairpin glycosidases
acaagattatgcaagacacattgaattatctcttcttttttacgaagcccaacgttccggtaagcttccagaaaacaacagaatttactggagacatgatagtgaacttgaagctggtgctgataatggtgtcgatcttactggaggatattatgatgctggtgataatgcaaagttcaacttcccaggtgcagctactatgactcttttagcctggagtggtgttgattatgctgaaggttataaaaacgctggtcaatgggagtatttattagatgctgtccgttggggtgctgactactttatgaaatgtcacactggtaaaactgaactttatgctcaagttggtgatggtaacactgaccactctttctggtatcctcctgaatatgttcaatacgaatacccatcatttaaggttactgctgatgctccaggttccgaagttgcaggtgaaacagctgctttcttagctgctgcttctattcttttcaaggatgaagacccaacatactctgctactttattaaagcattcaaaggaaatatatgactttgctgataaatatcgtggtgattacactgttgctgttcctgcagtcagtttctataatacttacagtggttacatggatgaattagcttggggtgctgcttggcttcttagagccacaggtgatgaatcttatcttgaaaagtacaatgttattgccaataaaaaatatgaatcttatgatccaaagaaatttacaggttctactggaccaatctcttgggatgataagagaccaggttgttatattttaatagcaatgattacaggtgatgaaaaacgtattaatgaagcctacaattactgtgatgctgtattaactcaaccacgtactgctggtggtttatggtatgatgatggtttatctatttggggttctaaccgttacgcttcaaatgctgcttctatggttgctatgtttgctaactaccttccagaatcagatccaaagcgtgcaaagtatgttgaatttgttaagcaacaaactgattatattctcggtgataatccagctaaaattaactatgttgttggtgctgaagctaattcaccaaaatcggttcaccaccgtggtgcctctggtgtattcgattctcaagataaggctgctaaaccagatgaaaatatctatactttatggggtgctttagctggtggtccagataagaatgacaagttcgttgatagtcgtaaggattatcaaatgagtgaagttgctcttgattataatgcagctttccaaatgaatcttgctttccttactaaagaagg

SEQ ID NO: 26993 - DNA, 1308 bp, Neocallimastix californiae
  Six-hairpin glycosidases
tcgtgattatgcaagaattttaaatttaaatttacgtttctatgaatgtcagtggtcaggaaaagcaccagaacataaacaagtatattggagatatgattcagctttagaagatggcgcagatgttggtttagatcttactggaggtttctatgatgcaggtgatcatgtaaaattcaatttaccaatgtcttatgccatgacaatgttagcttggggtggaattgatttatatgataattatgtagctgctggtcaaattgattatttacttcaaatggttaaccatggagctgattattttgttagatgtcaccctgaaaaagaagttatctatgcccaggttggtgtaggcgatgttgatcattgcttttgggttcctccagaattaatgactatggaaagaccaactgtatgtaaacttactccagaaaatggtgcttctgatgttactggtcaaatggcagctgcattagctagtgcttctatattaaacaaaaagtatggtaacactgaaaaagctgaattatatttaaaacatgctattgaaatctttgactttgctgataagtacagagatgtttataataatccatgtcctgaaggtgcttccttctatccttctgcttcatataaggatgaattggtatggggtgctgcatgggtatatcgtgcctctggtgatgaaaagtattatcaaaaggcagatgaatattatgattctcttgctttatctggtcgtaatttaattggtccaattacatgggatgatgcttcatctggtattgtattcttgatgtctaaaccaggattcggttcaaattgggaaagatatttaggtgaagctcaacactatgttgaccagtatttaaatgataagggtgctcgtactgatggaggtatgttatggtatagttccgtttcaggttggggatctgctcgtcatgcaatggctggtactttcctttactgtatctttaatacctaccataagccaactgatccaaaatactttaatttcattcaagaacaagctgattatattcttggtaataatccatttaatcgttctcttgttgttggttctattccaggctatgaaccattgaatgttcaccatcgtggttctcatggaggttattcaccactttctccaccagaacacaatatgtatcctttatatggtgctcttgctggtggtccacttcaaaacgatttttgggatgatgatcgtaacaattatgttactaatgaagttgcttgtgattataatgctggtattactggtgttatggcctatcttactcc

SEQ ID NO: 26994 - DNA, 1305 bp, Neocallimastix californiae
  Six-hairpin glycosidases
agattatgcccgtcaccttgaactttctatcctcttttatgaagctcaaagatctggaaaattaccagataacaatagaatttactggcgtggtgacagtatgttagaagctggttctgataataaagttgatttaactggtggttattatgatgctggtgataatataaaatttaactttcctcaggctagttctcttactcttttatcatggagtgctgtagagtggaaggatggttataaacaggctggtcaatgggaatatatgaaagatttaattaaatggggtatggattacttcattaagtgtcatactgataaatatgtcttatatggtcaagttggaaatgctaaattagatcataattcttgggtatcgccagaaaatatttcttatgattatccatcttacaagattactgactcttccccaggttccgatcttgcagctgaaacctctgctgctttagttgcagcttcaatggtttttagagatgaggatccaaattatgctgatcttttattaaaacatggtaaagaactttatgaatttgctgataaatatagaggttcatatgatgaatctataccagaagcaaatgactattatcattcaaatagttacaatgatgaacttgtttggggtgcagcttggttattcagagctacaggtgaagaatattataagtctaaggtagatgctatttgggattatccttatgacgaaaatgattctaataagttccttgattctaaaaatccaatttcatgggatgataaaaaggcttcatcatatactttaatggctatgattactggcgatcaaaaatatcttaaggaagctactactcacagtgatttaatggtaaatcatacaactacccctggaggattatggtataatgaaaatttatctgtatggggatcaaatagatatgcttctaatgctgcttttactgtagctatgatgacttctataatgaatgatgatgattctaaacgtcaagaatacattgatttcgttaagaaacaaacagattacattcttggtgacaatccagcaaaaatcgattatgtggttggtgctgcaccaaattcaccaaaggcagttcaccatcgtggtgcatcaggtactaaagatgtttatgaaaatccagatgagaatacatacgtcttatatggtgctcttgctggtggaccaggtccaaaggatgaatacaaagatattcgtgaggattatcaaaaaaatgaagtcgctttagattataatgctgccttccagggtcttttagccttccttattca

SEQ ID NO: 26995 - DNA, 1884 bp, Neocallimastix californiae
  Six-hairpin glycosidases
tgctgctgatgcttatgctcaacgtgctattgatcattacaacaaaatgactaacggtggtcaatacaatactgattatttctcaccagaaactgttccatatcactcaattgaaactcttatggttgaagctccagatcatggtcacgaatctgtatctgaaacttactctttctggatctggttagaagctgttaacggtaaacttactggtaactacgacggtattaacactgcctggagttacttagaaaagcacatgattccagatgctaagaaccaaccaggtaatagtaaatataacccatcttctccagctacttacgctccagaagatgatgatattactaactacccagctcaacttgtcttccaagatggtcttgttggtgaagatccaatcgctaaggaacttcaacaagcttacaacacttgggatatctatgccatgcactggattattgatggtgataactggtacggttatggtcaacaagctgatggtaagactaagccatctttcattaacactttccaacgtggttcttctgaatctacttggaagactgttccacacccatgttgggaagaattcaagtggggtggtagaaatggtttcttagatcttttcactggtgataacaactacgctaagcaatggagatacactgctgctccagatgctgatgctcgtgctattcaagctgcttacttcggttacatgtgggctgaagaagatggtgttgatctttctgatctcgcttctaaggctgccaagcttggtgattacattcgttacgctcaatacgataaatacttcaagaagatcggtaactgtattggtcatgacagatgttctgctggtcgtggtaagaactctgctcactaccttatctcctggtacttcgcttggggtggtggtttacaaggtgactgggcttggagaattggttcttctcacactcacactggttaccaaaacccattagccgcttgggttctttctactcaatctgctttcaagccaaaatctagaactggtgctgacgattgggctacttctcttgaccgtcaattagaattattcagatggttacaagcttctgaaggttgtattgctggtggtgccactaactcatggcaaggtcactacgctcaaccaagcagtgatattactaccttctacggtatgtactatgactggcaaccagtttaccacgatccaccatcaaacaactggactggtatgcaaggttggggtatggaacgtgtctgttctctttactacatttctggtaatgaaaaggccggaactatctgtagagattgggccaaatgggttaagaacactgttcgtgttaatggtaatgaagttattcactccactaaccttgaatggtctggtaacccagatgaatggaacagcaacaacttcaacaagtctggtcgtaacagatcccttcacggtacctcatcttctgatggtctcgatcttggtactcttgcctctatcattaagggtttattatgggtttctgctaaggataatgatgccgaaggtattcaacttgttcttgatgttatgaatgctattgaacaatacagtgacgatcttggttacgctgctgaagaaccacgtggtgattacagtaaattcggtgaagaagtttacattccatctggttggactggtaagaatgctcaaggtgctaacattcgtagtggtgttactttcattgatattcgtccaaaatacaagcaagatccagattgggctcaagttgaaaactaccttaatggtggtagtgaaccacgtttcacttatcacagattctgggctcaaactgaaattatggttgccaatggtcttatctctatcttagg

SEQ ID NO: 26996 - DNA, 1911 bp, Neocallimastix californiae
  Six-hairpin glycosidases
gaagcgtgctagtgatgcctacgctcaacgtgctattgaacattacaacaaaatgactaacggtggtcaatacaatactgaatatttctcaccagaaaatgttccatatcactcaattgaaactcttatggttgaagctccagatcacggtcacgaatctgtatctgaaacttactccttctggatctggttagaagctgttaacggtaagcttactggtaactacgacggtattaacactgcctggagttacttagaaaagcacatgattccagatgaaaagaatcaaccaggtaacagtaaatataacccatcttctccagctacttacgctccagaagatgatgatattactaactacccagctcaacttgtcttccaagatggtcttgttggtgaagatccaatcgctaaggaacttcaacaagcttacagaacttgggatatctatgccatgcactggattattgatggtgataactggtatggttatggtcaacaagctgatggtaaatctaagccatctttcattaacactttccaacgtggtgcttctgaatctacttggaagactgttccacatccatcttgggaagaattcaagtggggtggtagaaatggtttcttagatcttttcactggtgataacaactacgctaagcaatggagatacactgctgctccagatgctgatgctcgtgctattcaagctgcttacttcggttacatttgggctgaagaagatggtgttgatctttctgatctcgcctctaaggctgccaagcttggtgattacttacgttactctcactatgataaatatttcaagaagatcggtaactgtgtcggatacgacaaatgttctgctggtcgtggtaagaactctgctcactaccttatctcctggtacttcgcttggggtggtggtttacaaggtgactgggcctggagaattggttcttctcacactcacactggttaccaaaacccattagctgcttggattctttctactcaatctgctttcaagccaaagggttctactgctgttaaggattggcaaacttctcttgaccgtcaattagaattaattagatggttacaagctactgaaggttgtattgctggtggtgccactaattcatggcaaggtcactatgctgaaccagacagtgatattactaccttctacggtatgtactatgactggcaaccagtttaccacgatccaccatcaaacaactggactggtatgcaaggttggggtatggaacgtacttgttctctttactacgtttctggtaatgaaaaggccggaactatctgtagagattgggccaaatgggttaaggaaactgttcgtgttagtggtggtcaagtaattcacgctactaaccttgaatggtctggtaacccagatgaatggaacaagaacaacttcaacaagtctggtgctaaccgttctcttcacggtactgtttctgctgaaggtcttgatcttggttcaattgcttctatcattaaggctttattatgggtttctgctaaggatggtgatgaagaaggtattgaccttgctattcaagttatggatgctattgaaaactacaaggatgatctcggttatgctgctgaagaagctcgtgctgattacagtaaattcggagatgaagtttacattccatctggttggactggtaagaatgctcaaggtgctaaccttaagagtggtgttactttcattgatattcgtccaaaatacaagcaagatccagattgggctcaagttgaaaactaccttaacggtggtagtgaaccaaccttcacttaccacagattctggggtcaaactgaaattatggttgccaatggtcttatctctatcttaggttatggtgacagaactccaaa

SEQ ID NO: 26997 - DNA, 1503 bp, Neocallimastix californiae
  Six-hairpin glycosidases
tcttgttggtgaagatccaatcgctaaggaacttcaacaagcttacaacacttgggatatgtacgctatgcactggattattgatggtgataactggtacggttatggtcaacaagctgatggtaaatctaagccatctttcattaacactttccaacgtggttcttctgaatctacttggaagactgttccacacccatgttgggaagaattcaaatggggtggtagaaacggtttcttagatcttttcactggtgataacaactacgctaagcaatggagatacactgctgctccagatgctgatgctcgtgctattcaagctgcttacttcggttacatttgggctgaagaagatggtgttaacctttctgatctcgcctctaaggctgccaagcttggtgattacatgcgttacgctcaatacgataaatacttcaagaagatcggtaactgtattggtcacgacaaatgttctgctggtcgtggtaagaactctgctcactaccttatctcctggtacttcgcttggggtggtggtttacaaggtgactgggcctggagaattggttcttctcacactcacagtggttaccaaaacccattagccgcttgggttctttctactcaatctgctttcaagccaaagtctaaatctggtgctgacgattgggctacttctcttgaccgtcaattagaattattcagatggttacaagcttctgaaggttgtattgctggtggtgccactaactcatggcaaggtcactacgctaaaccaggtagtgatattactaccttctacggtatgtactatgactggcaaccagtttaccacgatccaccatcaaacaattggactggtatgcaaggttggggtatggaacgtgtctgttctctttactacgtttctggtaatgaaatggccggaactgtctgtagagattgggccaaatgggttaagaacactgttcgtgttagtggtggtcaagtagttcacgctactaaccttgaatggtctggtaacccagatgaatggaacaagagcaacttcaacaagtctggtcttaaccgttcccttcacggtactgtttctgctgaaggtcttgatcttggttcaattgcttctattattaagggtttattatgggtttctgctaaggatggtgatgaagaaggtattgacctttctctccaagttatggatgctattgaaaactacaaggatgatctcggttatgctgctgaagaagctcgtgctgattacgataaattcggtggtgaagtttacattccatctggttggactggtaagaacgctcaaggtgctaaccttaagagtggtgttactttcattgacattcgtccaaaatacaagcaagatccagattgggctcaagttgaaaactaccttaacggtggtagtgctccaaccttcaaataccacagattctggggtcaaactgaaattatggttgccaatggtcttatctctatcttagg

SEQ ID NO: 26998 - DNA, 1440 bp, Neocallimastix californiae; identical to SEQ ID NO: 24830
  Six-hairpin glycosidases

SEQ ID NO: 26999 - DNA, 1290 bp, Neocallimastix californiae
  Six-hairpin glycosidases
tcaagattatgctagacatcttgaattaaacttcttattctatgaagctcaacgttctggtcctcttccaagtaccaaccgtattccatggagaggtgactctggtcttgaccatggttctgatgttggtgttgatcttactggtggttactatgatgccggtgataatgtaaagtttaacttcccacaagcattctctatgaccgctatctcttggatgggtattgaatttgctaagggtgttgaaatggctaatcaaactgaatacttaaaggataccgttaaatggggttgtgattacttattaaagtgtcatgaaaagggtaccgatgttttctacatgcaagttggtgatggtgatattgatcatcaatactggaaagcttatgaaaatattgactatccaactccaacttttttcgttgattctaaaaacccaggtactgaagttactggtgaaactgcagctgcctttgctgctgcttctattcttttcaaggatagtgatccagaatactctgctactcttttagatcaagcaaaggaatggtatgaatttgctgacaagtatcaattcgattattctcaatctgttccagcagctggatcatactacaagagttataatggttacaatgatgaactcgcttgggccgctatctggctttatcgtgcacttggtgatgaagcttacttagaaaaggctaagagtctagttgctaattacaaactcagtgaagttggtattgattgggatagtaagtaccagggtgtcattgttatccttgcccaacttggtgttaaagaatacgttgaaaaggttgaagcttgggttaaggatatctgtactaatggaaagttttctccaggtggtctttacattaacaaagatagtgaatggggttccaaccgccgtgctactgctatggctgccagtttaatttactatactcataaccttccagaaggtaatgaattacgtgaaatggctaagaaattcgctaaatcccaagctgattatattcaaggtgctaatccactcggtattgattatgttgttggtgctgatgaaacctctccacgttctgttcaccaccgtactgcttctggtgctgcttgtattgaatgtgatccagttcaaaatgttcacattatttacggtgccttagctggtggtccagatgttgaagataattaccttgatgacagagctgactataagaagaatgaagttgctcttgattacaatgtctgttatgctgctgttcttgcttatcttgttgaagaagg

SEQ ID NO: 27000 - DNA, 1761 bp, Neocallimastix californiae
  Six-hairpin glycosidases
ttataaaaatcattataataaattaaatttacataattcaacatcttcattctataatttagactctatcccttatacaactttagaaactttatatatagatcaaacagtagattatggtcatataacaactataaaagaattttcatataaactttggatagaagcaatacaagggaaaatatcaggaaaatggaaatctttcgttaatgcttggaatatatttgaaatgaatatgattcctaaagaagaaaatcaaagaggaagttatatttattattcgaataatcataattcacagaataatcaagatacactatataaaagtttaaatgaatattatcaaacctggtcaatatatttaccgcattataaaattgatacagataattggaatatgtattttagtaaatcaaatgaaaaacgatttataaatacatacaaaaataataataaagactcaatatggagttcattgacatatccaagcttaataaattcaaaagattttgttaatccatatgttaaagcagatagtccagaaatgaaacaatgggagtatataagtgattcaaagtatgtttcaaaaataattgaaactatttattgggcttattgctggtcaaatgagcaaaaaaaaagaaaattcatggacactattttaaaaaaagttttaagaatgagtgattatatgttatattttataaatagtaacgaatcattacaagaatttaatgtagaatcaaaagatgatgacttaaattatcttgtatctcgctatttttcatggaaaggtgatatacatggaaaatggttaacaaagaaagtttcatcaaatattataggtattggaagccaaaatcctttagttgcttatatattatcgaacattaaggaatttaaatccgacaatgaagatattatattaaaatggaagaaaacgtacaaaaggcaaatagaatttattcgttggttacaaagttcagaaggagccattgttggaaatgctatttatatatcaagttctattgaaattaataaagtacccactttttataatctcgtgttttctaataattcaaatgaagaagaaaataatttatttagtactcaatgtttcgtttttgaaagtattgctgaactctattatattacaaaggataaagatattgagacaatcttatttaaatggttagattgggtattaacggttttccatttaacaagtgatagatcttttagaataccaaatagattatcatttgaaggtcaacctgaaaaatggataccaaatacgaaaattaaagatcataaaaataagcatttgaatgtaattatagaagactttaataatgatttaggggttgcggcatcattatcaaaaattttactttgggttggtaaaaaaataaataatgaagattatttaacacttggaagggaaattttagaaagacaagaaattttaaataaagatgaggatggttatgctactgaagaaaaattctatcaatatcgtctttttaataaaaaattaccaattcaaaaggattttaaaggtgtttatggtagatctacaaaaattaatgataaatctagtttcttgtcaatccgtccatactataaacgcgataaaaattggaaaaaaattcaaacttttttagataaaggaactcctgtaccaaaatttagatatcatcgattttgggaacaatgtgaaattttatcggctcaaggactttactccctattatatacaaa

SEQ ID NO: 27001 - DNA, 1308 bp, Neocallimastix californiae
  Six-hairpin glycosidases
agattatgctcgtcaccttgagctttccattcttttttatgaagctcaaagatctggtaaattaccagctaataacagaattttctggcgtcatgacagtatggttgatgctggtaaagataacaatgttgatttaactggtggttactatgatgctggtgataatgtaaagtttaactttccacaagcaagtgcattaactcttctcgcttggagtgctgttgattggaaagatggttacaaggaagctggtcaatggggatatatgaaagatttattaaagtggggtatggattatttcattaaatgccacaccagtaaatatgaattatacggtcaagttggtaatggtagtttagatcatggagcttgggttccaccagaggaaattgattatgaatatccatcatacaagattactgcttctgctccaggttcagatcttgctgctgaaacatctgcttctatggttgctgcttctatggctttcagagatgatgatccagaatatgcggatattttattaaagcatggtaaggaactttacgattttgctgaaaaataccaaggtacttacgataaatctattactgatgctaagggttattatcgttcctacagtggattcaatgatgaacttgtttggggtgccgcctggttatacagagctacaggtgataagacctataaggataaagttgataagatttgggatactccatatggtgatcttgatccagataagttcctcggttctggtggtccaatttcttgggatgataaaaaggctgctgcttatgccttaatggctcttactactggtgagagcaagtatgttgatgaatctactaagcacagtgaattaatggttaactacaaaactactccaggaggtttatggtatgatactaatttatctatgtggggttctaacagatatgcttccaatgctgcttttactgttgctatgttagctacatctatggatgctaatgacgctaagcgtaaggaatacgttaaattcattaagaagcaaattgattatattattggtgataatccagccaaggttgattacgttgttggtgccgacccaagttctccaaaggctgttcaccaccgtggtgcttccggttcaaagggtgctgataagggtccaagtgaaaatgtctttgttttatatggtgctctcgctggtggcccaggagctaatgataatttcaaggatgctcgtgataactatgaaatgaacgaagttgctttagattacaatgctgccttccaaggtcttttagccttccttattca

SEQ ID NO: 27002 - DNA, 1308 bp, Neocallimastix californiae; identical to SEQ ID NO: 27001
  Six-hairpin glycosidases

SEQ ID NO: 27003 - DNA, 1887 bp, Neocallimastix californiae
  Six-hairpin glycosidases
gcgtgcttctgacgaatacgctaaaagagttactgatacatacaatgctgttactggtaatggaagttacaattctgattacttctcaccagaaaatgttccataccactcaatcgaaactatgatggttgaagctccagattacggtcatgaatctgtttctgaaacttattccttctgggtttggttagaagctattaatggtaagatgaccggtaattacaagggtgttgaaactgcttggagttacttagaaaagcatcttattccaaacagtaagaaccaaccaggtatgagtaagtacaacacttcttctccagctacttatgctccagaagacgatgatattactaactacccagctcaacttgtcttccaagacggtattgttggtgaagatccaattgctaaggaactccaacaagcttatggtacctgggatatctatgctatgcactggattattgatggtgataactggtatggttacggtcaaaatggtgatggtacttctaagccatcctttattaacactttccaacgtggtgcctctgaatccgcttggaaaactgttccacacccatgttgggaagaaatgaaatggggtggacgtaacggtttcttagatcttttcactggtgataacaattattctaagcaatggagatacactgctgctccagatgctgatgctcgtgctattcaagctgcttatttcgcttatatttgggctgaagaagatggtcaaaatctttcctcccttgcttctaaggctgctaagcttggtgattacttacgttactctcactacgataaatactttaagaagattggtaactgtataggataccaacaatgtcaaggtggtcgtggtaagaactctgctcactaccttatttcctggtacttctcttggggtggtggtttacaaggtgactggtcttggagaattggttcatcccacactcacactggttaccaaaacccattagctgcttgggttctttctactcaagctgctttcaagccaaagggttcttctgctgtcaaggattggtcaacttccttagatcgtcaattagaattattcagatggttacaagctgctgaaggttgtattgctggtggtgctactaactcatggcaaggtcactacgctcaaccaccaagtgacattacctccttttacggtatgtactatgattggcaaccagtttaccatgatccaccatccaacaactggactggtatgcaaggttggggtatggaacgtgtctgttccctttacttcatttctggtaacgaaaaggccggtaaggtttgtcaagaatgggctaaatgggttaagaacaatgttcgtgttaatggtagtgaaattgttcacgctactaacttcgaatggtctggtaacccagatgaatggaagccttctaacttcaacaagtctggtcttaacgcttctcttcatggtaccgtttcctctgaaggtgttgatcttggttctcttgcctctatcatcaaaggtttaatgtgggtttccatgaaggataatgatcaagaaggtattgatctttccgttcaagttatggatgccattgaacaatacaaggataaatatggttatggtgttgaagaagcccgtgaagattacattaaattcaatgaagaagtttacattccaagtggatggactggtaagaatgctcaaggtgctaacatcaggagtggagttaagttcattgatatccgtccaaaatacaaggaagatccagactgggctcaagttgaaaacttccttaacggtggtgaagctccaagattcacttatcacagattctgggctcaaactgaaattgccgttgctaacggtcttatctctatctatgg

SEQ ID NO: 27004 - DNA, 1329 bp, Neocallimastix californiae
  Six-hairpin glycosidases
atctcaagattatgctagacacattgaattatctcttcttttctacgaagctcaacgttctggtaaacttccagaaaataacagaatttattggagacatgatagtatgctcgatgccggttctgaccatggtgtcgatcttactggtggttattatgatgctggtgataatgtcaagttcaatttcccaggtgcagcttctttaactcttcttgcttggagtgctattgattatgctgatggttacaaaaaggctgaccaatggaaatacattttagatgctgtccgttggggagctgattactttgttaaatgtcacactggtaaaaatgaactttacgttcaagttggtgacggtcaaatcgatcatggttattggtacccaccagaatatattcaatacaagcattcatcttacaagattactgcttctgctccaggttctgaagttgctggtgataccgcttccttcttagcagcttcttctattcttttcaaggaggaaaatccaacttattctgctactttattaaagcatgctatagaaatttacgattttgctgataaatatcgtggtgaatatactaaggctgttccagatgctcaaggtttctatgctaattggagtggtttcttggatgaattagcatttggtgctttatggttatacagagctactggtgatgaaagttatatgcaaaaattctctactattgctgatgctaaatatggtgaacaagatagtaaggcttatggtatttcaactggtccaatctcatgggatgataagagaccaggagcttatattcttgctgctatggttactggtgaagaaaaacgtttacaacaagcctactggtattgtgatagtattttaactcaaccaaaaactagaggtggtttatggtatgatgctagtctttctcaatggggttctaaccgttatgcctctaatgctgctgctatgcttgctatgtttgccaattatcttccaaaatctgatccaaaacgttctaaatacgttgactttgtaaaaaaacaaaccgattatattcttggggataatccagctaagattaattacgtggttggtgctgaagctagttcaccaaaagccgttcatcatcgtgctgcttctggtacctatgattctcaagatactaatgccaaaccaaccgactataacatctttactttatggggtgctttagctggtggtccaggtccaaaggatgaatataccgattctagaaagaattatcaaatgaatgaagttgctcttgattataatgctggtttccaaatgaatcttgctttccttactaagga

SEQ ID NO: 27005 - DNA, 231 bp, Neocallimastix californiae
  Six-hairpin glycosidases
ctgggatggttctaacccatctgaacaatacactttaggtgaaactggtgctaatgctgtcgctactttcgctttaatgggtcttagtggatacgaaaatgttattaagaagaacttaaagatggcttgggatgctcaacttatgactggtagatatcgttattacgatggtttagttcactacttagctatgcttcaccttcttggtagtttcaagatctggaagccagc

SEQ ID NO: 27006 - DNA, 1074 bp, Neocallimastix californiae
  Six-hairpin glycosidases
ttacttaggtaaaactgatgctgaaattcaaggaaagttagatcaactttggaatcactattttaagggtgataacaacagtaaagtattttacgatagaggtaatgaaggttacattttagatgttaacaacaatgatgttcgttctgaaggtatgtcttatggtatgatgattgctgttcaaaccaaccacaaagaagaatttgacaaactttggaactgggctaagaaccacatgtggcacaaaggtggtggctgggatggttacttcgcctggcaacgtaacaccagtggtaatggtggtgatgataattgtgctccagatggtgaaatgtactttatgatgtcacttctctttgccgctaaccgttggaataacaaacaatatatggatgatgctcaatacatcattaagagaatgtgggataatccacaacacaaacttttcaaccaacaaaataacattattactttccaaccacaaggtactggtaacaatttctctgatccatcctacgatttaccagcctttgttgatcttatttctcgttggtctactaccaaccaaaatagatggaagtctgctgctcaagctactcgtgatcacttatacaaatcttctaacacaagatctggtttattcagtgattacaacaactttgatggtactccacactctgaaagttacaaccaaaatgcttccaagtacatgtacgatgctatgcgttgtgctatgaactttggtatggattactacttattcggtagtgatgccaaacgtgaaactgaaatggctaagcgtatcattgatttctttgaaaaagatggttacaaacatgctcgtttcaactgggatggttctggtgcttctgaacaatacactcaaggtgaaactggtgccaatgctgttgcttgtttcgctttaatgggtactcaaggttatgaaagtattattaagaagaacttacaaatggcttgggatgttaaaccaatgactggtcaataccgttactatgatggtttagttcactacttagctatgcttcaccttctcggtagtttcaagatttggaa

SEQ ID NO: 27007 - DNA, 594 bp, Neocallimastix californiae
  Six-hairpin glycosidases
tcgtgattatgcaagaattttaaatttaaatttacgtttctatgaatgtcaatggtctggaaaagccccagaacataaacaagtatactggagatatgattctgctttagatgacggagctgatgttggattggatcttactggaggtttctatgatgctggtgatcatgtaaaattcaatttaccaatgtcatatgctatgactatgttagcttggggtggtattgatttatatgacaattatgttgctgctggtcaactcgactatttacttcaaatggttaaccatggagcagattattttgttagatgtcacccagaaaaggaagttatttatgctcaagttggtcttggtgctattgatcattgtttctgggttccaccagaattaatgactatggaaagaccagcagcttgtaaacttacaccagataatggtgcttctgatgttactgctcaaatggcagctgcattagctagtgcctctatattaaataaaatgtatggtaataaagaaaaagctgaattatatttaaagcatgctattgaaatttatgactttgctgataagtacagagatgtctataataatcc

SEQ ID NO: 27008 - DNA, 1029 bp, Anaeromyces robustus
  Six-hairpin glycosidases
ttctgctggtcgtggtaagaactctgctcactaccttatctcctggtacttcgcttggggtggtggtttacaaggtgactgggcttggagaattggttcttctcacactcacactggttaccaaaacccattagccgcttgggttctttctactcaatctgctttcaagccaaaatctagaactggtgctgacgattgggctacttctcttgaccgtcaattagaattattcagatggttacaagcttctgaaggttgtattgctggtggtgccactaactcatggcaaggtcactacgctcaaccaagcagtgatattactaccttctacggtatgtactatgactggcaaccagtttaccacgatccaccatcaaacaactggactggtatgcaaggttggggtatggaacgtgtctgttctctttactacatttctggtaatgaaaaggccggaactatctgtagagattgggccaaatgggttaagaacactgttcgtgttaatggtaatgaagttattcactccactaaccttgaatggtctggtaacccagatgaatggaacagcaacaacttcaacaagtctggtcgtaacagatcccttcacggtacctcatcttctgatggtctcgatcttggtactcttgcctctatcattaagggtttattatgggtttctgctaaggataatgatgccgaaggtattcaacttgttcttgatgttatgaatgctattgaacaatacagtgacgatcttggttacgctgctgaagaaccacgtggtgattacagtaaattcggtgaagaagtttacattccatctggttggactggtaagaatgctcaaggtgctaacattcgtagtggtgttactttcattgatattcgtccaaaatacaagcaagatccagattgggctcaagttgaaaactaccttaatggtggtagtgaaccacgtttcacttatcacagattctgggctcaaactgaaattatggttgccaatggtcttatctctatcttagg

SEQ ID NO: 27009 - DNA, 1056 bp, Anaeromyces robustus
  Six-hairpin glycosidases
caaatgttctgctggtcgtggtaagaactctgctcactaccttatctcctggtacttcgcttggggtggtggtttacaaggtgactgggcctggagaattggttcttctcacactcacactggttaccaaaacccattagctgcttggattctttctactcaatctgctttcaagccaaagggttctactgctgttaaggattggcaaacttctcttgaccgtcaattagaattaattagatggttacaagctactgaaggttgtattgctggtggtgccactaattcatggcaaggtcactatgctgaaccagacagtgatattactaccttctacggtatgtactatgactggcaaccagtttaccacgatccaccatcaaacaactggactggtatgcaaggttggggtatggaacgtacttgttctctttactacgtttctggtaatgaaaaggccggaactatctgtagagattgggccaaatgggttaaggaaactgttcgtgttagtggtggtcaagtaattcacgctactaaccttgaatggtctggtaacccagatgaatggaacaagaacaacttcaacaagtctggtgctaaccgttctcttcacggtactgtttctgctgaaggtcttgatcttggttcaattgcttctatcattaaggctttattatgggtttctgctaaggatggtgatgaagaaggtattgaccttgctattcaagttatggatgctattgaaaactacaaggatgatctcggttatgctgctgaagaagctcgtgctgattacagtaaattcggagatgaagtttacattccatctggttggactggtaagaatgctcaaggtgctaaccttaagagtggtgttactttcattgatattcgtccaaaatacaagcaagatccagattgggctcaagttgaaaactaccttaacggtggtagtgaaccaaccttcacttaccacagattctggggtcaaactgaaattatggttgccaatggtcttatctctatcttaggttatggtgacagaactccaaa

SEQ ID NO: 27010 - DNA, 315 bp, Anaeromyces robustus
  Six-hairpin glycosidases
taaatacgttgactttgtaaaaaaacaaaccgattatattcttggggataatccagctaagattaattacgtggttggtgctgaagctagttcaccaaaagccgttcatcatcgtgctgcttctggtacctatgattctcaagatactaatgccaaaccaaccgactataacatctttactttatggggtgctttagctggtggtccaggtccaaaggatgaatataccgattctagaaagaattatcaaatgaatgaagttgctcttgattataatgctggtttccaaatgaatcttgctttccttactaagga

SEQ ID NO: 27011 - DNA, 1074 bp, Anaeromyces robustus; identical to SEQ ID NO: 27006
  Six-hairpin glycosidases

SEQ ID NO: 27012 - DNA, 117 bp, Anaeromyces robustus
  Six-hairpin glycosidases
tggtccaggtgctagagatgattacaaggatgatcgtaccaattataattctaatgaagttgctttagattataatgctgcttacactggtcttcttgctttcttaattcaagaagg

SEQ ID NO: 27013 - DNA, 1308 bp, Anaeromyces robustus
  Six-hairpin glycosidases
agattacgcccgtcaccttgaactttctattcttttctatgaagctcaaagatctggtaaattaccagctaataacagaatcttctggcgtcatgacagtatggttgatgccggtaaagacaacaatgttgatttaactggtggttactatgatgctggtgataatgtaaaattcaatttcccacaagccagtgctcttactcttcttgcttggagtgctgttgaatggaaagatggttataaagaagctggtcaatgggaatacatgaaagatttacttaagtggggtatggattattttgttaaatgtcacactggtaaaactgaattatatggtcaagttggtaatggtagtcttgatcatggtgcttgggttccaccagaggatattgattataagtatccatcttataagattactgcttctgctccaggttctgatcttgctggtgaaactgctgctgcattagttgcttcttctttagcattcagagaagatgatccagaatatgctgatctcttattaaaacatggtaaggaaatttatgattttgccgataaatatagaggttcatatgataaatctattgaagatgctaagggttactaccgttcatatagtggttatatggatgaacttgtttggggtgctgcttggttatataaggctactggtgacgaaacatataagaaaaaggttgatgccatttgggattatccatacggtgatcttgatccagataagttccttggatcaactggcccaatttcttgggatgataagaaggcttcctcctatgctttaatggctatgattactggtgaagataaatatgtcaaagaatctactactcacagtgatttaatggttaattataaaactactccaggtggtttatggtatgatactaatttatctatgtggggttctaacagatatgcttctaatgctgctttcactgttgctatgttagcttcttctatggatcctaatgattcaaaacgtaagcaatatgttaagtttgttcaaaagcaaattgattatattattggtaacaatccagcaaaggttgattacgttgttggtgctgatccaagctcaccaaaggctgttcatcatcgtggtgcttcaggttctaagggagctgataaaggtccagatgaaaacgtattcgtcttatatggtgctcttgctggtggtccaggtgcaagagatgattataaggatactcgtaataattatgaaatgaatgaagtagctttagattacaatgctgccttccaaggtcttttagctttccttgttaa

SEQ ID NO: 27014 - DNA, 1329 bp, Anaeromyces robustus
  Six-hairpin glycosidases
atctcaagattacgcaagacatattgaactttctttacttttctatgaagctcaacgttcaggtaaacttccagaaaacaaccgtatttactggagacacgacagtttacttgatgctggtgctgataatggtgttgatcttactggtggttattatgatgctggtgataatgtcaagtttaacttcccagctgctgccactttaactcttttagcttggagtggtattgattatgctcaaggttataaagaagctggtcaatgggattatcttcttgatgctgttcgttggggtgctgattatttcatgaaatgtcacactggtaaaaacgaactttatgttcaagttggttctggtagagttgatcacgcttactggtatccacctgaatatgttaactatgatcatccatcattcaagattactgcttcagctccaggttctgaagttgctggtgacactgcttctttcttagctgctgcttctattttattcaaggatgttgattcatcatattctcaaaaatgtttaaaacatgctaaagaaatttacgatttcgctgatacttaccgtggtgaatacactaaagctgttgaagatgctcaacaattctatgctaattggagtggtttccttgatgaattagcttttggtgctttatggctttacagagctactggtgatgaatcttaccataataaatttaagaaaattgctgatgattcttacggtgaacaagatactaaagcttatggtatttgtactggtccaatttcatgggatgataagagaccaggttcttacattcttgctgccatgattactggtgaagaaaaacgtttacaacaagcttattggtattgtgatgaagttttaactcaaccaaaaactccaggtggtttatggtataatgataacctttctaaatggggttctaaccgttatgcttctaatgccgctgctatgttaggtatgttcgctaattaccttccaaagagtgatccaaaacgttctaaatatattgattttgttaagagtcaaaccaattatattcttggtgataatccagctaaggttaactatgttgttggtgccgaagctaattcaccaaaggctgttcatcaccgtggttcttctggtacttacgattctcaagataataatgctaaaccaaccgattacaatatttacactttatggggtgctttagctggtggtccaggaaaatctgatgattattctgatactagaaagaattatgaaatgaatgaagttgctcttgattacaatgctgcattccaaatgaatcttgctcttcttgttaaaga

SEQ ID NO: 27015 - DNA, 954 bp, Anaeromyces robustus
  Six-hairpin glycosidases
tcgtgattatgcaagaattttaaatttaaatttacgtttctatgaatgtcaatggtctggaaaagccccagaacataaacaagtatactggagatatgattctgctttagatgacggagctgatgttggattggatcttactggaggtttctatgatgctggtgatcatgtaaaattcaatttaccaatgtcatatgctatgactatgttagcttggggtggtattgatttatatgacaattatgttgctgctggtcaactcgactatttacttcaaatggttaaccatggagcagattattttgttagatgtcacccagaaaaggaagttatttatgctcaagttggtcttggtgctattgatcattgtttctgggttccaccagaattaatgactatggaaagaccagcagcttgtaaacttacaccagataatggtgcttctgatgttactgctcaaatggcagctgcattagctagtgcctctatattaaataaaatgtatggtaataaagaaaaagctgaattatatttaaagcatgctattgaaatttatgactttgctgataagtacagagatgtctataataatccatgcccagaaggtgcttccttctacccatctgcttcttataaggatgaattagtctggggtgctgcttgggtttaccgtgcatcaggtgatgaaaaatactataaaaaagctgatgaatattatgattctcttgctttatctggacgtaatttaattggaccaattacatgggatgatgcttcatctggtattgttttcttaatgtcaaaaccaggttttggttctaactgggaaagatacttaggcgaagctcaacattatgttgatcaatacttaaatgatatgggtgctcgtactgatggaggtatgttatggtacagttccgtttctggttggggatctgctcgtcatgctatggc

SEQ ID NO: 27016 - DNA, 1332 bp, Anaeromyces robustus
  Six-hairpin glycosidases
acaagattatgctagacatattgaactttctttacttttctacgaagctcaacgttctggtaaacttccagaaaataatcgtatttattggagattcgatagtcaacttgatgctggtgctgatcatggtgttgatcttactggtggttattatgatgctggtgataatgtaaagttcaatttcccagctgcagcagcattaactttattagcttggagtggtgttgattatgctgatggttataaaaaagctggtcaatgggattatttccttgatgctattcgttggggtgctgactattttatgaaatgtcacactggtaaaaatgaattatatttccaagtcggtgacggtaaaattgaccacacttattggtatccaccagaatatactgtctatgaacatccatcattaaaacttactacttccaaaccaggttctgaagtagctagtgatacagcttcatttttagctgctacctatatgatatttaaagatattgatccaacttacgctaaaaaatgtttacaacattcaaaagaaatttatgaatttgctgacaagtatcgtggtgattattcaaaatcatttggtaattatgtcaatgatttctataaaaattggggtacaattaatgatgaattagctttcggtgctttatggctttatagagctactggtgatgaatcttatttagctaaatataaggttattgctgatgcttcatatgatagtcgtgatgaaagtgcctatccaaattgtagtggtccaatttcatgggatgataaaagaccaggtgcctatgttcttggtgctattgttactggtgaagataaatatttagataaagctatcagctattgtgatgctgtattaactcaaccaaaaactcgtggtggtctttggtataataataacctttctaaatggggttcaaatcgttatgcttctaatgctgcttctatgttaggtatgttagctaattatcttccaaaggatcatccaaaacgttcaaaatatattgattttgttaaaagtcaaactaattatattcttggtgataatccagctaaagttaattttgttgttggtgctgaaaagaattcaccaaaggctgtacatcaccgtggtgcttctggtacttatgattctcaagatactaatgctaaaccaactgatcataatgtttacactatttggggtgctttagctggaggtccaggtaaggatgattcttataccgacacaagaaagaattatgaaatgaatgaagttgcccttgattataatgctgctttccaaatgaatcttgctttacttgttaaagaagg

SEQ ID NO: 27017 - DNA, 1425 bp, Anaeromyces robustus
  Six-hairpin glycosidases
tgtttctggtgatgctaagaagaaggttgaagctactttacaaaaggttaaaaacgttgcttatgaaacattaaaggaaagacatattgaagcttacaagaaacaattcgatcgtgttaagatagctcttccagttaacagtagtgctcaaaacccaactatggatagattagctaatttcaacagatcaggagatcaagatcttgtagctttaatgttccaatatggtcgttatttattaatttcttcttctcaaccaggaggtcaaccagctaatcttcaaggtatttggaatgatagtactgatgctccatgggatagtaaatataccattaacattaatgctcaaatgaattactggccagctgaagttacaaatcttagtgaatgtcatgaaccattattctcacttattcgtgatctttccgttactggtaaggaagctgcttcaagaatttataaggctgaaggttggatggctcaccataacactgatatctggcgtatctctggtccagttgatggtgctttctggggtatgtggccaaatggtggtggatggctttctactcacatctggcaacattatcttttcactggtgacaaagatttccttgaagaatattatccaatcttaagagatgctgctaaattctttgtttctagtatggttaaagatccaaatactggttacttagttactgttccatctacttcaccagaacatggttattcttctgatggttcatcaatgactgctggttgtactatggataaccaaattgcttatgatgttttaaatcaagctcttcttgctgctaaaactcttggtgttgatgactccttccaaaagactttacaaaatactatgaataatattgctccaatgcaagttggtcaatacaatcaattacaagaatggtttgttgatgctgataatccaagagatgatcattgtcatgtttctcacctttatggtctttacccaagtggacaaatttctccattcaaacaaccacttttattcgaagcttcaaagaatactcttactcaacgtggtgatatggctactggttggagtattggttggaagattaatctttgggctagacttttagatggtaatcatgcctataagattattcaaaatatgcttgttcttattagaagtggtgttgatggtagagtttatggtaatatgtttgatgctcacccaccattccaaattgatggtaactttggtttctgtgcaggtattgctgaaatgcttttacaaagtcatgatggtgctgttcatcttcttccagcacttccaagtgtatggagtgatggtagtattagtggtttagttgctcgtggtggttttgaagttagtattacttggaagagtggtaaggttactaaagctagtattaaatctaaaat

SEQ ID NO: 27018 - DNA, 108 bp, Anaeromyces robustus; identical to SEQ ID NO: 13922
  Six-hairpin glycosidases

SEQ ID NO: 27019 - DNA, 1308 bp, Anaeromyces robustus
  Six-hairpin glycosidases
tcgtgattatgctagaattttaaatttgaatttacgtttttatgaatgtaattggtctggtaaagctccagaacataaacaagtctattggagatatgactctgccttagaagatggtgctgatgttggcttagatcttactggaggtttttatgatgctggtgatcatgtcaaatttaatcttccaatgtcttatgctatgactatgttagcatggggtggtattgatttatatgaaaattatgtcgctgctggacaaatcgactatttagttcaaattgttaaccatggtgcagattactttgttaagtgtcatccagaaaaggaagttatttacgctcaagttggtcttggtgatgttgatcactgtttctgggttccaccagaattaatggaaatggaaagaccagctgtatgtaaacttactccagaaaatggtgcttctgatgttactgcacaaatggctgcagctttagcttcagcttctatcttaaataaaaaagttggaaatactgaaaaagctgaactttacttaaaacacgctattgaaatttatgactttgctgataaatacagagatgtttatggtaatccatgtccagaaggtgcttcattctatccatctgcttcatacaaggatgaattagtttggggtgctgcttgggtttaccgtgcttctggtgatgaaaaatattatgataaggctgatgaatattatgattctcttggtttatctggtcgtgttttaattggaccaatttcatgggatgatgcttcttcaggtattatcttcttaatgtcaaaaccaggttttggtaagaactgggaaagatatttaaatgaagctcaaatttatgttgatcaatacttaaatgataaaggatctcgtactgatgctggtatgttatggtacagttccgtatctggttggggatctgctcgtcatgctatggccggtgttttcctttattgtatatttaatacttaccacaaaccagaagatccaaaatactttaactttattcaacaacaagctgattacattcttggtaataatccatttaatcgttctcttgttgttggttctattccaggtcatgatccattaaatgttcaccatcgtggttctcatggtggttattcaccaatttcaccaccagaacataacatgtacactttatatggtgcccttgctggtggtccacttcaagatgattcatgggatgatgatagaaacaactatattactaatgaagtttcttgtgattataatgctggtattactggtgttatggcctatcttactcc

SEQ ID NO: 27020 - DNA, 1887 bp, Anaeromyces robustus
  Six-hairpin glycosidases
gcgcgctgatgatcaatatgcaaaacgtgctactgaacattacaatattattacaggtaatggttcttactcctcaaaatatttctcatcagaaaaagttccatatcactctgttgaaactcttatggtagaagctccagatcatggtcacgaatctgtatctgaaacttattctttctggatttggttagaagctgttaatggtaaacttacaggtaattatgaaggtgttgatactgcttggtcttacttagaaaagcatcttattccagacagtaagaatcaaccaggtaatagtaaatataatccatcatctccagctacctatgctccagaagatgatgatattactaattatccagctcaacttgttttccaagatggtattgttggtcaagatccaattgctcaagaacttcaacaagcctatggtaattgggatatgtatgctatgcactggattattgatggtgataattggtatggttatggtcaacaaggtgatggtacttctaaaccatctttcattaacactttccaacgtggttcctctgaatctacttggaaaactattccacatccatgttgggaagaattcaagtggggaggtccaaatggtttcttagatcttttcactggtgataattcttactcaaaacaatggagatacactgctgctccagatgctgatgctcgtgctattcaagctgcttactttggatatatttgggctaaggaagatggacaagatctttctgctgttgctgctaaagctgctaagcttggtgattatatgcgttatgctcaatatgataaatatttcaagaagattggtaattgtattggttataataaatgtgctgctggtagtggtaaaaattctgctcactaccttatttcttggtacttcgcttggggtggtggtttacaaggtgattgggcttggagaattagttcttcccacactcacagtggttaccaaaatccattagctgcttgggtactttcttctgaaccagctttcaaaccaaaatctagtactggtgctgaggattgggcaacatctcttgatcgtcaattagaattattcagatggttacaatcttctgaaggttgtattgctggtggtgccactaactcatggcaaggtcactatgctcaaccagatagttcaattactactttctatggtatgttctatgattggcaaccagtttatcacgatccaccatccaacaattggtctggtatgcaaggttggggtatggaacgtgtttgttcattatattaccttagtggtgatgaaagagctggtaaagtttgtcaagaatgggctaaatgggttaaaaagaatgttcgtgttagtaatggagaaattactcactgtactaatattaaatgggaaggtaatccagatgaatggaattcttctaactttaataaagctaaccttaatgcttcacttcacggtacttcctcttctgaaggtacagatcttggtaccgttgcttcaattattaaaggtttactctgggtttccttaaaagataatgaccaagaaggtattgatcttgttattgatgtaatggatgctatggaaaattacaaggatagtcttggttatgctgttaaagaagcacgtgaagattatgctaaattcggtggtgaagtttatgttccatctggttggactggtaagaatgctcaaggtgctaacattaagaatggtgttactttcattgatattcgtccaaagtataaacaagatccagattgggctcaagttgaaaacttccttaatggaggtgatccaccagaattcacatatcacagattctgggctcaaactgaaattatggttgctaatggtattctttccatttacaa

SEQ ID NO: 27021 - DNA, 1425 bp, Anaeromyces robustus
  Six-hairpin glycosidases
tgtttctggtgatccaaagaaaaaagctgaagctgctttagaaaaggtaatcaatacttcttatgaaacattgaagaaaagacatattgaagcttacaaaaagcaatttgatcgtgtaaaattatctcttccaatgaatgcttatgctcttaatccaactatggatagattagctaatttcaataaatctggagatcaagatcttgtaactttaatgttccaatatggtcgttatttattaatttcatcatcacaacctggtggtcaaccagcaactcttcaaggtatttggaatgataatattgatgctccatgggatagtaaatatactattaatattaatattcaaatgaattattggccagctgaagttactaatcttagtgaatgtcatgaaccattatttgaacttattcgtgatctttcagtttctggtagagaatctgcttcaaaactttataatgctgaaggatggatggctcatcataacactgatgtttggcgtatttcgggacctattgaaggtgcttattggggtatatggcctaatggtggtgcttggctttctactcatatatggcaacattatcttttcactggtgataaagaattccttaaagattattatgaagtattaaaaggagctgctcaattctttgttactgatttagttagagatccaaatactggatttttagtaacagttccatcaggatcaccagaacatggttattcagctgatggttcagctatgactgctggttgtactatggataatcaaattgcttatgatactatgaatcaagcacttcaagctgctaaaattcttggtcttgatcaagatttccaaaaaactttacaacaaactatggatggtttagctccaatgcaagttggtcaatacaatcaattacaagaatggtatgttgatgctgataatccaagagatgatcatcgtcatgtatcacatctttatggtctttatccaagtgcacaaatttcaccatttaaacaaccacttttattcgaagcttcaaagaatagtcttactcaacgtggtgatatggctactggttggagtattggttggaaaatcaatctttgggctagactttttgatggtaatcatgcctataaaattattaagaatttacttaatcttattagatcaggtgtagatggaagagtttatgctaatatgtttgatgctcatccaccattccaaattgatggtaactttggattctgtgctggtattgctgaaatgcttgtacaaagtcatgatggtgctgttcatcttcttccagctcttccagatgtttggggagatggtagtgtaagtggattaatggctcgtggtggttttgaagtaagtattacttggaagagtggtaaggttactaaagccagtattaaatctaagat

SEQ ID NO: 27022 - DNA, 1929 bp, Anaeromyces robustus
  Six-hairpin glycosidases
tactaatgatgagtatgctcaacgtgttattgaacagtacgaaaaattaaccaataatggtacttatgatacagattatttttcaaaagataattatttaccgttttattccattgaaactcttattgttgaagaggataatagtttttccagattagattatggtcacttatctacttctgaaactttatcttattggatttggttagaagctgttaatggtaaaattactggtaattatgaaggtgtagattgggcttggagtgtcatggaaaaatttttaattccctattcagagtatcaacgaggtaataatcgatataatagtaatgaaccatctatctatgttccagaatatgatggtatacaaaattatccaattccattaacttttcaaacaggaattgctggtatggatccaatagctaaagaacttcaagtcacctatggtacatgggatatgtattctctacattggcttgttgatggtgataattggtatggttatggtcaacaagaaaatggttataccagaccagtattaattaatacttttagacgtggtccatctgaatctgtttggcaaactattccacatccatcttttgatgaatttagatggggtggtagtaatggttttttagatctttttttcattgataataatttttattatcctaaacaatataaatatacaacttgtcctgatgctgatgctcgtgctattcaagctacctattttgcttatttatgggctaaagaagatggtatcaatcttccatattctattattttaagagctacaagacttggtgattatttacgttattctcattatgataaatattttaaaaaaattggtgattgttttaattataaattatgtacaccaggttccggtaaaaattcagcacattatcttatatcatgggcttattcttggggtggaggtataatgggagattggacttggagaagaggttcttcttatattcatagtggttatcaaaatccattagttgcttggatattttctactcaatcagcttttaaattaaaatcttccactggtaataaagattggtcggtttccttggatcgtcaattagaatttatgagatggttacaaactcctgaaggttgtattgctggaggtgcaacaaattcatgggaaggacaatataatacaccacctcaaaatataaccaatttttatggtatgtattatgattggcaaccggtttatcataatccatcctcaaataattggataggtatgcaagctcgaagtatagaacgagtttgttctttgtattatctttctggaaatcaaaaagctgaattaatatgtcaaacatgggtagaatggattaaaaaaaatatacaaattcatgattatgaaattattcatgctacaaaacttacatgggaaggtaatccagatgattgggattcatctagtttttataaaagtggcattaatacctctcttcatggtacagtttttgaaatgggatttgatcttggttctatggcttctattgttaaaagtcttttatgggtatcgatgaaagataatgatcaagaaggacttgatcttgctattcaaattatggatattattgaaaattataaggatgatttgggttatgccgtagaagaatttcatgataattattcaaaatttgcaaatccagtatattttcccaatgattggaagggtagaaatcctcaaggagcttatttaaaaagaggagcttgtttccttgatattcgaccaaaatataaagaagatcctgattggtatcaagttgaatattatcttaatgggtatgaaaatcctccagtatttacttatcatagattttgggttcaagctgaaattatgattgctaatggacttctttccatttataaagttaaaagtag

SEQ ID NO: 27023 - DNA, 1098 bp, Anaeromyces robustus
  Six-hairpin glycosidases
tttaaataaaattacaaaaatgagtgattatatgttatattttataaataatgatgcttcattacaatcttttaattctgactcaacggatgaaaataaaaattatctattatcacgttacttttcttggaaaggaagtatacatggaaaatggttaacaaagaaaataatttccaatataattggtattggaagtcaaaatccatttgttgcatatattttatcaaatgtcaaagaatttaattcagaaaatcctaattctgtaaataaatggaaaaaatcatataaaaggcaaattgaatttattcgttggttacaaagttcggaaggagcaatagtaggaaacgcaaaatatccttctaatattgatgatataaatcataaatcttctttttatgatcttatatttacttcatcaaatgaagaagaaaatgatttatttagtactcaatgctttgtttttgaaagtattgctgaactttattatattactaaagataaagatattgaaataattttatttaaatggcttgattgggtattatctgtttttcatttaacaagtgatagatcatttagaattccaaataaattatcatttgaaggtcatccggaaaaatggaaaccaaatacaagtattgaagatcatgaaaatgataatttaaatgttattgttgaagattacaataataatataggggttgcagcatcattatcaaaaattctattattggttggtaaaaaaaataataatgatgattatttaactttaggaagagatatattagaaaaaattgaattaataaataaagatgaatatggatatgctactgaagaaatattttataattatcgtttatttaataaaaaattaccaattcaaaaagatttcaaaggtgtttatggtcaatccgcaaaaattaatgataaatcaacatttatatctattcgtccttattataaaaaagataaaaattggaaaataattaaatcctatttaaatgatggaacaccagttccatcatttaaataccatagattttgggaacaatgtgaaattttattagcacaaggtctttattctcaatattatactaa

SEQ ID NO: 27024 - DNA, 1284 bp, Anaeromyces robustus
  Six-hairpin glycosidases
agattatgctagacatcttgaattaaatttcttattctatgaagcccaacgttctggtcatcttccagccaataatcgtattccatggagaagtgactctggtcttgaccatggtgctgataatggtgtagatcttactggtggttattatgatgctggtgataatgttaaattcaatttcccacaagcattctctatgactgctattgcttggtatggtcttgaattcgctaaaggtgttgaaatggctggtcaaactgaatatttaaaggataccgttaaatggggttgtgattatttattaaaatgtcataaaaagggtacagatgttttctatatgcaagttggtgatggtgatattgatcatctttattggaaggctgttgaagatattgattatccaactccatccttctatgttgattctaaaaacccaggtactgaagttactggtgaaactgctgctgcttttgctgctgcttctcttcttttcaaagaaagtgacccagaatattctgctactcttttagatcaagctgttgaatggtttaattttgctaatacttatagatttgattattctgtttctgttccaaaggttgctagttactataagagttggggtggttacaaggatgaacttgcctgggctgctatatggctttacaaagctcttggtgaagaaaaatacttagaattagctaaggatcttgttaaagattataaacttggtgaactcggttttgattgggatagtaaataccaaagtactattgttatccttgctcaacttggtgttaaggaatatgttgaaaaagttgaaaattgggttagagaaatttgtactaagggtaaattatctccaggtggtctttacattaataaagatagtgaatggggatcctgtcgtcgtgctacttctatggctgctagtttaattttctatactcatactcttccagaaggtaatgaattacgtgaaatggctaagaagtttgctcaatctcaagctgattatgttcaaggtaataatccacttggtattgatttcgttgttggtgctgatgcttcttcaccacgttctgttcatcatcgtactgcttctggtgctgattgtattgaatgtgatccagttgaaaatgctcatattatttatggtgctttagctggtggtccagatgaaaatgatcaatatgaagatattagagctgattaccaaaagaatgaagttgctcttgattataatgtttgttatgctgctgtttgtgcctatcttattgaaga

SEQ ID NO: 27025 - DNA, 1761 bp, Piromyces finnis
  Six-hairpin glycosidases
tcaaaatcattatgataaattaaatataaataattcttcctctatatactacaatgctgattcaataccatattctactttagaaaccctatatatagatcaaaatgtagattatggtcatttaacaacattaaaggaaatttcatataaactatggatagaagcattacaaggaaaaatttcaggaaaatggaaaccttttgttaatgcatggaacatatttgaaaataatatgataccaaaggatgaaagtcaaaaaggaaatagtaaatactattcaacaacaaataattcaataaatacaaaggattcactttataaagaattatatgaacaatatcaaacctggtctctatatttaccacataatattattgataccgataattggaataaatattttagtagcaaaaataaaaaaagattcattaaaaatcataaaaataatgataaagattcaatatggtgttcattattttatccaagtataattaactctaataattatttaaatccatatttggataatgaaattactgaaataaagcaatgggaatatattagtgattctcgttacatttcaaaaataatagaatcggtttatagggcttattgctggtcaactgagcaaaaaaagaataaatttatgaaaccaatacttaaaaaaatcataaaaatgagtgattatatgttatattttattaatagtgatgattcgctacaatcatttgattccgaatcaaatgaagacaataagaattatttattatctcgatacttttcatggaaaggcagtatggaaggaaagtggttagaaaaagaagttactacagatattattggtattggaagtcaaaatccattaattgcttatgtcttatcaaatgataaaaacttcaattcagaaaaccctgaatttgtatcaaaatggaagaaatcataccaaagacaaattgaatttatacgatggttacaaagttctgaaggagctattgttggtgtagctcaatacccttcaaatcataatttaagctcaaaaaaaatgccttccttttataatttaatattctcaaaaaattttgaagttgaagaaaataatttatttggtactcaatgttatgtttttgagagtcttgctgaactttattatattactaaagataaggatattgagattataataacaaaatggttagattgggttttatccgtttttcatttaacaagtgatcgattatttaaaattccaaataagctaacctttgaaggacaaccaaaagattggaatcaaaaggatggtataaagaatcacaaaaatgataaattaaatgttatcgttgaagactataacaatagtattggtgttgctgcctcattgtcaaaaatcttattattaattggaaaaaaaaataataatgaagattatctaacgcttggtagagatattttagaaagaatagaaatatcaagtaaagatagtcaaggttattcagtaaccgaaactttttatcaatatcgtcgttttaataaaaaattaccaataccagaaggatttaaaggaatgtatggaagatcatcaaaaattaatgataaatcaacctttatctccatacgtccatactataaaaaggacaaagattggaaaataataaatacctttttaaataaaggaacaaccattcctacttttaaatatcacagattttgggaacaatgtgaaatattattagcacaaggtctttactcacaatattacacaaa

SEQ ID NO: 27026 - DNA, 1467 bp, Piromyces finnis
  Six-hairpin glycosidases
tgttagtggagatgcccagaaaaaggccgaagccgctattcaaagcgcattaaaatcaacttactcatctcttaaagataaacatcttgctgcttacaaaaagcaatttgatcgtgtaaagatttctcttccagtaaatagcaatgctgaaaatcaaactgtcgatcgtttagccaatttcaatagatctggtgatcaagatcttattgctttaatgttccaatatggtcgttatttattaattacatcatcccaaccaggtggtcaaccagctaatttacaaggtatttggaatgatagtattgatgcaccatgggatagtaaatacactatcaatattaacactgaaatgaactactggcctgctgaagttacaaatcttagtgaatgtcacgatcctcttttctcacttattcgtgatctttcagttaccggaagagaagctgcatcaaaaatatataacgctgaaggttggatggctcatcataacactgatatctggcgtattactggtcctgtagatggtgcttactggggtatgtggccaaacggtggtggatggctctctactcacatctggcaacactacctctttactggtgacaaggatttccttaaccaaaattactctattttaaaagaagctgcaaagttctttgtttcaagtatggttaaagatccaaacactggatatttagctaccgttccatccacatctccagaacatggttacagttatgatggatcatccatgacctctggttgtactatggataaccaaattgctttcgatgttttaaaccaagctcttcttgcagccaaaacccttggtgttgatgaatctttccaaaaaactttacaaaataccatcaatagtattgcaccaatgaaggtaggtcaatacaatcaattacaagaatggtttgttgatgctgataatccaaaggatgatcaccgtcatgtatcacatctttatggtctttacccaagtggtcaaatttcaccattcaaacaacccctcttatttgaagccgctaaaaacactcttacccaacgtggtgatatggccacaggttggagtattggttggaaaattaatctttgggcaagacttttagatggtaaccacgcctataaaatcattcaaaatatgcttaatcttttaccaactggtcaagacaatagtaatggtagagtttatgctaatcttttcgatgctcacccaccattccaaattgatggtaactttggtttttgtgctggtattgctgaaatgcttttacaaagtcatgatggtgctgttcatcttcttccagctattccagatgtctggaatgaaggtagtattagtggtttaattgcaagaggtggtttcgaagttgatatgatttggaagagtaaaaagattaccaaagccactataaagtctaagattggtggagttttacgtattcgtagcaataccca

SEQ ID NO: 27027 - DNA, 1341 bp, Piromyces finnis
  Six-hairpin glycosidases
tcaagattatgctagacatcttgaattatcacttcttttctatgaagctcaacgttctggtaaacttccagaaaataacagaatttactggagacatgatagtttagtcgatgctggtgctgataatggagttgatcttagcggtggttattatgatgctggtgataatgctaaatttaatttcccaggtgctgctacaatgacccttttagcttggagtggtattgattatgctgaaggttacaaggaagctggtcaatggaaatatcttcttgatgcagttcgttggggagctgattacttcatgaagtgtcacactggtaagaacgaactttatgctcaagttggtaagggtactactgatcactcatactggtacccaccagaatatgcttcctacgatcacccatcattcaagctcacagcttcagctccaggtaccgaagtttcagccgatactgcctcattcttagctgcttcatacctcttattcaaggatgaagatccatcctatgcctccaagtgtttacaacactccaaggaaatctatgactttgccgatacttaccgtggtgattacattggatcaattccagatgtttcaggtttctactccacctggagtggttacaatgatgaattagcctttggtgccttatggctttacagagccactggtagcgaaagttacatgaagaaattcgaagccattgctgatgcagtttatggagctcaagatactaaggcttacggtacttgtactggaccaatttcatgggatgataagagaccaggtgcttatattcttgccgctattattactggtgatgaaaagcgtatgaaacaagcttcttggtattgtgataatgtcttaacacaaccaaaaactccaggaggtttatggtatgatgccaacctttctaagtgggcttctaaccgttatgcttcaaatgctgctgctatggttgctatgtatgctaactatcttccaagttctgattctaagcgttctaaatatgtagattttgttaagaagcaaactgattatattcttggtgataatccagctaagattaattacgttgttggtgctgaagccaactcaccaaaggccgttcaccatcgtggtgcttctggtacttatgattctcaagatactaatgccaagccaactgattacaacatctttactttatggggtgctttagctggtggtccaggtccagatgatgaatacactgattctagaaagaattatgaaatgaacgaagttgcacttgattacaatgctgctttccaaatgaatcttgctttccttacacaagaaggattaagtaaacc

SEQ ID NO: 27028 - DNA, 1347 bp, Piromyces finnis
  Six-hairpin glycosidases
tcaagattatgctagacatcttgaattatcacttcttttctatgaagctcaacgttctggtaaacttccagaaaataacagaatttactggagacatgatagtttagtcgatgctggtgctgataatggagttgatcttagcggtggttattatgatgctggtgataatgctaaatttaatttcccaggtgctgctacaatgacccttttagcttggagtggtattgattatgctgaaggttataagagtgctggacaatgggaatatattttagatgctgttcgttggggtgctgattatttcatgaaatgtcacactggtaaaaatgaactttatgctcaagttggtgatggtaatactgaccatgctttttggtatccaccagaatatgtaaaatatgattacccatcatttaaagttactgctgaaaaaccaggttctgaagttgctggtgaaactgctgcatttttagctgctgcttccattctttttaaggatgaagattcttcttattctgccaaattattaaagcatgctaaggaaatttatgaatttgctgatacttatcgtggagattatactggtgctattccaggagttgttagtttctacagtacctatagtggttataatgatgaattagcttggggtgctgcttggcttcttagagctacaggtgatgaatcttatcttaataaatacaatgttatcgcaaataaaaagtatgaatcttatgatccaaagaaattttcaggtgctactggaccaatctcttgggatgataagagaccaggttgctatattttaattgctatggttactggtgatgaaaatcgtatcaaggaagcttacaattattgtgatgctgtattaacacaaccaaaaactccaggtggtttatggtatgatgatggtttatctatgtggggttctaatcgttatgcatcaaatgctgcctccatgttagctatgtttgcaaactatcttccaaaatctgatccaaaacgtgctaagtatgttgaatttgttcaacaacaaactaattatattcttggtgacaacccagctaaaattaattacgttgttggtgctgaagccaactcaccaaaagctgttcaccatcgtggttcttctggtgtcttcgattcacaagataaagctgcaaaaccagatgaaaacatttacacattatggggtgctttagccggtggtccagatgaaactgattcttacattgatactcgtagtaactttagaaccaatgaagtagctcttgattacaatgctgctttccaaatgaatcttgctttcctcgtaaaggaaggtttcaataaaccagatccaga

SEQ ID NO: 27029 - DNA, 1341 bp, Piromyces finnis
  Six-hairpin glycosidases
tcaagattatgctagacacattgaattatctcttcttttctatgaagctcaacgttctggtaaacttccagaaaataacagagtttactggagacatgatagtttacttgatgctggtgccgataatggtgttgatcttaccggtggttattatgatgctggtgataatgttaagttcaacttcccaggtgctgctgccttaactcttcttgcttggagtggtattgattatgctgatggttacaaagaagctggtcaatgggattatatattagatgcagttcgttggggtgctgattactttgtcaagtgtcacactggaaagaatgaactctacgttcaagtaggtaagggtgctactgatcatggtttctggtatccaccagaatatgttcaatatgatcatccatcttacaaaattactgctgctgctccaggttccgaagttgctggtgatactgcttctttcttagctgctgcctctattcttttcaaggatattgattcttcatattcttctaatttattaaaacatgctattgaaatatatgattttgctgattcttaccgtggtgaatacattaaggctgttccagatgctcaaggtttctactctaactggagtggttacaatgatgaattagcctttggtgctttatggttatacagagctactggtgaaagtaagtatatggataaattcagtaaaattgctgatgcttcttacggtgaacaagatactaaggcttatggtacatgtactggtccaatttcatgggatgataagagaccaggtgcttatattcttgccgctattattactggtgatgaaaagcgtatgaaacaagcttcttggtattgtgataatgtcttaacacaaccaaaaactccaggaggtttatggtatgatgccaacctttctaagtgggcttctaaccgttatgcttcaaatgctgctgctatggttgctatgtatgctaactatcttccaagttctgattctaagcgttctaaatatgtagattttgttaagaagcaaactgattatattcttggtgataatccagctaagattaattacgttgttggtgctgaagccaactcaccaaaggccgttcaccatcgtggtgcttctggtacttatgattctcaagatactaatgccaagccaactgattacaacatctttactttatggggtgctttagctggtggtccaggtccagatgatgaatacactgattctagaaagaattatgaaatgaacgaagttgcacttgattacaatgctgctttccaaatgaatcttgctttccttacacaagaaggattaagtaaacc

SEQ ID NO: 27030 - DNA, 1350 bp, Piromyces finnis
  Six-hairpin glycosidases
tcaagattatgctagacatcttgaattatcacttcttttctatgaagctcaacgttctggtaaacttccagaaaataacagaatttactggagacatgatagtttagtcgatgctggtgctgataatggagttgatcttagcggtggttattatgatgctggtgataatgctaaatttaatttcccaggtgctgctacaatgacccttttagcttggagtggtattgattatgctgaaggttacaaggaagctggtcaatggaaatatcttcttgatgcagttcgttggggagctgattacttcatgaagtgtcacactggtaagaacgaactttatgctcaagttggtaagggtactactgatcactcatactggtacccaccagaatatgcttcctacgatcacccatcattcaagctcacagcttcagctccaggtaccgaagtttcagccgatactgcctcattcttagctgcttcatacctcttattcaaggatgaagatccatcctatgcctccaagtgtttacaacactccaaggaaatctatgactttgccgatacttaccgtggtgattacattggatcaattccagatgtttcaggtttctactccacctggagtggttacaatgatgaattagcctttggtgccttatggctttacagagccactggtagcgaaagttacatgaagaaattcgaagccattgctgatgcagtttatggagctcaagatactaaggcttacggtacttgtactggaccaatttcatgggatgataagagaccaggtgcttatattcttgccgctattattactggtgatgaaaagcgtatgaaacaagcttcttggtattgtgataatgtcttaacacaaccaaaaactccaggaggtttatggtatgatgccaacctttctaagtgggcttctaaccgttatgcttcaaatgctgctgctatggttgctatgtatgctaactatcttccaagttctgattctaagcgttctaaatatgtagattttgttaagaagcaaactgattatattcttggtgataatccagctaagattaattacgttgttggtgctgaagccaactcaccaaaggccgttcaccatcgtggtgcttctggtacttatgattctcaagatactaatgccaagccaactgattacaacatctttactttatggggtgctttagctggtggtccaggtccagatgatgaatacactgattctagaaagaattatgaaatgaacgaagttgcacttgattacaatgctgctttccaaatgaatcttgctttcctcgtaaaggaaggtttcaataaaccagatccaga

SEQ ID NO: 27031 - DNA, 1338 bp, Piromyces finnis
  Six-hairpin glycosidases
tcaagattatgctagacatcttgaattatcacttcttttctatgaagctcaacgttctggtaaacttccagaaaataacagaatttactggagacatgatagtttagtcgatgctggtgctgataatggagttgatcttagcggtggttattatgatgctggtgataatgctaaatttaatttcccaggtgctgctacaatgacccttttagcttggagtggtattgattatgctgaaggttataagagtgctggacaatgggaatatattttagatgctgttcgttggggtgctgattatttcatgaaatgtcacactggtaaaaatgaactttatgctcaagttggtgatggtaatactgaccatgctttttggtatccaccagaatatgtaaaatatgattacccatcatttaaagttactgctgaaaaaccaggttctgaagttgctggtgaaactgctgcatttttagctgctgcttccattctttttaaggatgaagattcttcttattctgccaaattattaaagcatgctaaggaaatttatgaatttgctgatacttatcgtggagattatactggtgctattccaggagttgttagtttctacagtacctatagtggttataatgatgaattagcttggggtgctgcttggcttcttagagctacaggtgatgaatcttatcttaataaatacaatgttatcgcaaataaaaagtatgaatcttatgatccaaagaaattttcaggtgctactggaccaatctcttgggatgataagagaccaggttgctatattttaattgctatggttactggtgatgaaaatcgtatcaaggaagcttacaattattgtgatgctgtattaacacaaccaaaaactccaggtggtttatggtatgatgatggtttatctatgtggggttctaatcgttatgcatcaaatgctgcctccatgttagctatgtttgcaaactatcttccaaaatctgatccaaaacgtgctaagtatgttgaatttgttcaacaacaaactaattatattcttggtgacaacccagctaaaattaattacgttgttggtgctgaagccaactcaccaaaagctgttcaccatcgtggttcttctggtgtcttcgattcacaagataaagctgcaaaaccagatgaaaacatttacacattatggggtgctttagccggtggtccagatgaaactgattcttacattgatactcgtagtaactttagaaccaatgaagtagctcttgattacaatgctgctttccaaatgaatcttgctttccttacacaagaaggattaagtaaacc

SEQ ID NO: 27032 - DNA, 1350 bp, Piromyces finnis
  Six-hairpin glycosidases
tcaagattatgctagacacattgaattatctcttcttttctatgaagctcaacgttctggtaaacttccagaaaataacagagtttactggagacatgatagtttacttgatgctggtgccgataatggtgttgatcttaccggtggttattatgatgctggtgataatgttaagttcaacttcccaggtgctgctgccttaactcttcttgcttggagtggtattgattatgctgatggttacaaagaagctggtcaatgggattatatattagatgcagttcgttggggtgctgattactttgtcaagtgtcacactggaaagaatgaactctacgttcaagtaggtaagggtgctactgatcatggtttctggtatccaccagaatatgttcaatatgatcatccatcttacaaaattactgctgctgctccaggttccgaagttgctggtgatactgcttctttcttagctgctgcctctattcttttcaaggatattgattcttcatattcttctaatttattaaaacatgctattgaaatatatgattttgctgattcttaccgtggtgaatacattaaggctgttccagatgctcaaggtttctactctaactggagtggttacaatgatgaattagcctttggtgctttatggttatacagagctactggtgaaagtaagtatatggataaattcagtaaaattgctgatgcttcttacggtgaacaagatactaaggcttatggtacatgtactggtccaatttcatgggatgataagagaccaggtgcttatattcttgccgctattattactggtgatgaaaagcgtatgaaacaagcttcttggtattgtgataatgtcttaacacaaccaaaaactccaggaggtttatggtatgatgccaacctttctaagtgggcttctaaccgttatgcttcaaatgctgctgctatggttgctatgtatgctaactatcttccaagttctgattctaagcgttctaaatatgtagattttgttaagaagcaaactgattatattcttggtgataatccagctaagattaattacgttgttggtgctgaagccaactcaccaaaggccgttcaccatcgtggtgcttctggtacttatgattctcaagatactaatgccaagccaactgattacaacatctttactttatggggtgctttagctggtggtccaggtccagatgatgaatacactgattctagaaagaattatgaaatgaacgaagttgcacttgattacaatgctgctttccaaatgaatcttgctttcctcgtaaaggaaggtttcaataaaccagatccaga

SEQ ID NO: 27033 - DNA, 1308 bp, Piromyces finnis
  Six-hairpin glycosidases
agattacgctcgtcaccttgaactttctattcttttctatgaagctcaaagatctggtaaattaccagctaacaacagaattttctggcgtcatgacagtatggttgatgctggtaaagataacaaggttgatttaactggtggttactacgatgctggtgataacgttaaattcaatttcccacaagctagtgctcttactcttcttgcttggggtgcctacaaatggaaggatggttacaaggaagctggtcaatgggattacatgaaggatttacttaagtggggtatggattacttcattagatgccacactgacaagtacgtcttatacggtcaagttggtaatggtagtttagatcacggtgcttgggttgctccagaagatattgactacgaatacccatcttacaagattactgcttccgctccaggttctgatcttgctgctgaaacttctgcctctatggttgctgcttctttagctttcagagatgaagacccaacctatgctgatactttattaaagcatggtagagaactttatgaatttgctgaaaagtaccaaggtacttacgataaatctattactgatgccaagggttactaccgttcttacagtggttttaatgatgaacttgtttggggtgctgctatgttatacgctgccactggtgaacaaacttacaaggacaaggtcgataagatttggaacactccatacggtgaacttgatccagatagattccttggttctactggtccaatttcttgggatgataagaaggctgctgcttacgctttaatggccatcactactggtgaaagcaaatatattgaagaatccactagacacagtgatttaatggttaattacccaactactccaggtggtttatggtacgatactaacttatctatgtgggcttctaacagatatgctgctaatgctgctttcactgttgctatgttagctacctctatggatgctaatgactctaagcgtaaggaatatgttgcttttgttaagaagcaaattgattacattcttggtgataacccagctaaggttgattacgttgttggtgctgacccaagttctccaaaggctgttcaccaccgtggtgcttctggttcaaagggtgctgacaagggtccagatgaaaacgttttcattttatatggtgctcttgctggtggtccaggtgccaaggataattacaaggatgctcgtaacaactatgaaatgaacgaagtcgccttagattacaatgctgccttccaaggtcttttagccttccttatcac

SEQ ID NO: 27034 - DNA, 915 bp, Piromyces finnis
  Six-hairpin glycosidases
aaaacttactacaggtgctccaggttctgaagttgctggtgatactgcttcatttttagctgctacttacattattttcaaggatatagatccttcttatgccaaaaaatgtttacaacattctaaggaaatttatgaatttgctgatacctatcgtggtgattattcaaaatcttttggtgattatgtcaatagtttctataagaattggggtactatttatgatgaattagcttttggtgctttatggctttacagagctacaaatgatgaatcttacttaaaaaagtataaagcaattgctgatgcttcctacgatactagagatgaaaatgcctatggtaattgtaagggtccaatttcatgggatgataagagaccaggtggttatgtacttggtgctatcgttactggtgaagaaaaatatattgaaaaagctttaagttattgtgatatggtattaactcaaccaagaactccaggtggtttatggtatgatagtaacctttccaaatggggttctaaccgttatgcttctaatgctgcatccatggtagctatgatggcagatttccttccaaaggatgatgctagacgtgcaaagtatgttgatttcgttaaaagtcaaacagattatattcttggtgataatccagctggtgttaactatgttgttggagctgaagaaaattcaccaaaggctgttcaccaccgtgctgcctcaggtacttatgattctcaagatcgtaatgccaaaccaaatgatcataatgtttacactatttggggtgctttagctggtggtccagcaaaggatgattcctacgaagataccagaaagaattatgaaatgaatgaagttgctcttgattataatgctgctttccaaatgaatcttgctttccttgttaagga

SEQ ID NO: 27035 - DNA, 126 bp, Piromyces finnis; identical to SEQ ID NO: 13946
  Six-hairpin glycosidases

SEQ ID NO: 27036 - DNA, 129 bp, Piromyces finnis
  Six-hairpin glycosidases
tgctcttgctggtggtccagatggtaatgataagtacactgatgaccgtaccaattacaactccaatgaagtcgctttagattataacgctgcttacactggtcttcttgccttcttaattcaagaagg

SEQ ID NO: 27037 - DNA, 1198 bp, Piromyces finnis
  Six-hairpin glycosidases
tcgtgattatgctagaattttaaatttaaatttacgtttctatgaatgtcaatggtctggaaaagctccagaaaataaacaagtctattggagatatgattctgccttagaagatggtgctgatgttggtttagatcttactggaggtttttatgatgctggtgatcatgtaaagtttaatttaccaatgtcttatgctatgactatgttggcttggggtggtattgatttatatgataattatgttgctgctggtcaaattgattacttaattcaaatggtaaatcatgctgctgactattttgttagatgtcatccagaaaaggaagttatttatgctcaagttggtcttggtgatgtagatcattgtttctgggttccacctgaattaatggaaatggaaagaccagctgtttgtaagcttactccagagaatggtgcttctgatgtaactgcacaaatggctgctgcattagctagtgcatcaattttaaataagaaatatggtaatgaggaaaaagctgaactttatttaaagcatgctattgaaatttacgattttgctgataaatacagagatgtatatggtaatccttgtccagaaggtgcatctttctatccatctgcttcttataaagatgaattagtttggggtgctgcttgggtttaccgtgcatctggagatgagaaatactatgaaaaggctgattcatattatgattctcttggtttatctggtcgtgtattaattggtccaatttcttgggatgatgcttcatcaggtattattttcttaatgtcaaagccaggatttggttcaaactggaaaagatatttaggtgaagctcagacttatgttgatcaatacttaaatgataaatcagctcgtaccgatgctggtatgttatggtatagtgctgtttctggttggggatctgctcgtcatgctatggctggtacattcctttactgtattttcaatacttatcataacccaactgatccaaaatactttaatttcattcaacaacaagctgattatattcttggtaataatccatttgatcgttcacttgtagttggttctattccaggtcatgatccacttaatgttcatcaccgtggttctcatggaggttattcaccaatttctccaccagaacacaacatgtatactttatatggtgctcttgctggt

SEQ ID NO: 27038 - DNA, 1204 bp, Piromyces finnis
  Six-hairpin glycosidases
tcatactcgtgattatgctagaatcttaaatttgaatttacgtttttatgaatgtaattggtctggtaaagctccagaacataaacaggtttattggagatatgattcagcattagaagatggtgcagatgttggattagatttaactggaggttactatgatgctggtgatcatgttaaatttaatttaccaatgtcatatgcaatgactatgttagcttggggtggtattgatttatatgataattatgttgctgctggtcaaattgattatttagttcaaatcgttaatcatggagcagattactttgttaaatgccatccagaaaaagaagttatttatgctcaagttggtcttggtgatgtagatcattgtttctgggttccacctgaattaatggaaatggaaagaccagctgtttgtaagcttactccagagaatggtgcttctgatgtaactgcacaaatggctgctgcattagctagtgcatcaattttaaataagaaatatggtaatgaggaaaaagctgaactttatttaaagcatgctattgaaatttacgattttgctgataaatacagagatgtatatggtaatccttgtccagaaggtgcatctttctatccatctgcttcttataaagatgaattagtttggggtgctgcttgggtttaccgtgcatctggagatgagaaatactatgaaaaggctgattcatattatgattctcttggtttatctggtcgtgtattaattggtccaatttcttgggatgatgcttcatcaggtattattttcttaatgtcaaagccaggatttggttcaaactggaaaagatatttaggtgaagctcagacttatgttgatcaatacttaaatgataaatcagctcgtaccgatgctggtatgttatggtatagtgctgtttctggttggggatctgctcgtcatgctatggctggtacattcctttactgtattttcaatacttatcataacccaactgatccaaaatactttaatttcattcaacaacaagctgattatattcttggtaataatccatttgatcgttcacttgtagttggttctattccaggtcatgatccacttaatgttcatcaccgtggttctcatggaggttattcaccaatttctccaccagaacacaacatgtatactttatatggtgctcttgctggt

SEQ ID NO: 27039 - DNA, 609 bp, Piromyces finnis
  Six-hairpin glycosidases
catgtactacctttctggtaacgaaaaggctggtcttgtctgtaagaactgggctcaatgggttaaggacactactcgtgttaacggtggtgaagttatccacgctactaacttaggttgggatggtaatccagatgaatggaaggcctctaacttcaataagtctggtcttaacaaatctcttcacggtactgttacttctgaaggtcttgatcttggttccattgcctctattatgaagggattaatgtgggtttctatgaaggatggtgatgaagaaggtctttctcttgctgtttctgtcatggatgccattgaaaactacaaggatgatcttggttacgctacctacgaagaacgtcttgactacgccaacttcggtcaagaaacttacattccatctggctggagtggtaagaacgctcaaggtgccaacattaagagcggtgctactttcattgacattcgtccaaagtacaaggaagatccagattgggctcaagtcgaagacttcctcaacggaggtaacccaccagccttcacttaccacagattctggggtcaaaccgaaattatggttgccaatggtcttattgccatttacgactt

SEQ ID NO: 27040 - DNA, 1887 bp, Piromyces finnis
  Six-hairpin glycosidases
gcgtgctagcgatgaatacggtagacgtgttactgatctttacgatgttatgactggtaatggttcttacagttctgaatacttctctgctgaaaaggttccataccactctgttgaaactcttatggttgaagctccagatcatggtcacgaatctgtctctgaaaccttctctttctggatttggttagaagctgttaacggtaagatcactggtaactacgatggtgtcgaagaagcctggaactacttagaaaagcacattattccagacagcaagaaccaaccaggtaacagtaagtacaacccatcttccccagctacttacgctgctgaacacgatgatattgatggttacccatctaaacttatcttccaagatggtattgttggtgaagatccaattgctaaggaactttctcaagcctacggtaactgggatatctacatcatgcactggattattgatggtgataactggtacggttatggtcaacaaggtgatggtacttctaagccatctttcattaacaccttccaacgtggtgcttccgaatctacttggaagactgttccacacccatgttgggaagccatgaagtggggtggtcgtaacggtttcttagatcttttcactgttgataactcctacgctaagcaatggagatacactgctgctccagatgctgatgctcgtgctgttcaagctgcttacttcgcctacatctgggctgaagaagatggtgttaacctttcttctgttgctgctaaggctgccaagcttggtgattacttacgttacgctcaatacgataaatacttcaagaagattggtaactgtgttggttctgacaaatgctctgctggtcgtggtaagaactctgctcactaccttatctcctggtacttcgcctggggtggaggtttacaaggtgactgggcctggagaattggttcttctcacactcacagtggttaccaaaacccattagctgcctggattctttctactcaagctgcctttaagccaaagtcttccactggtgctaaggattgggctacttccatggaccgtcaattagaattattcagatggttacaaactccagaaggttgtattgctggtggtgccactaactcatggcaaggttcttacgctcaaccatccagtgatatcactaccttctacggtatgtggtacgactggcaaccagtttaccacgacccaccatccaacaactggactggtatgcaaggttggggtatggaacgtgtctgttccttatactacgtttccggtgatgaaagagctggaaaggtttgccaagaatgggccaagtgggttaaggacactactcgtgtcagtggtggtgaaattgttcacgctactaaccttgactggtctggtaacccagatgaatggaattcttccaacttcaacaagtctaaccttaaccgttcccttcacggaactgtttcttccgaaggtgttgatcttggttccatcgcttctatcattaagggtttaatgtgggtttctatgagagatggtgaccaagaaggtattaacctttctattgaagttatggatgccattgaaaactacaaggatgatcttggttacgctacctacgaagaacgtcttgactacgccaacttcggtcaagaaacttacattccatctggctggagtggtaagaacgctcaaggtgccaacattaagagcggtgctactttcattgacattcgtccaaagtacaaggaagatccagattgggctcaagtcgaagacttcctcaacggaggtaacccaccagccttcacttaccacagattctggggtcaaaccgaaattatggttgccaatggtcttattgccatttacga

SEQ ID NO: 27041 - DNA, 1887 bp, Piromyces finnis
  Six-hairpin glycosidases
gcgtgctagcgatgaatacggtagacgtgttactgatctttacgatgttatgactggtaatggttcttacagttctgaatacttctctgctgaaaaggttccataccactctgttgaaactcttatggttgaagctccagatcatggtcacgaatctgtctctgaaaccttctctttctggatttggttagaagctgttaacggtaagatcactggtaactacgatggtgtcgaagaagcctggaactacttagaaaagcacattattccagacagcaagaaccaaccaggtaacagtaagtacaacccatcttccccagctacttacgctgctgaacacgatgatattgatggttacccatctaaacttatcttccaagatggtattgttggtgaagatccaattgctaaggaactttctcaagcctacggtaactgggatatctacatcatgcactggattattgatggtgataactggtacggttatggtcaacaaggtgatggtacttctaagccatctttcattaacaccttccaacgtggtgcttccgaatctacttggaagactgttccacacccatgttgggaagccatgaagtggggtggtcgtaacggtttcttagatcttttcactgttgataactcctacgctaagcaatggagatacactgctgctccagatgctgatgctcgtgctgttcaagctgcttacttcgcctacatctgggctgaagaagatggtgttaacctttcttctgttgctgctaaggctgccaagcttggtgattacttacgttacgctcaatacgataaatacttcaagaagattggtaactgtgttggttctgacaaatgctctgctggtcgtggtaagaactctgctcactaccttatctcctggtacttcgcctggggtggaggtttacaaggtgactgggcctggagaattggttcttctcacactcacagtggttaccaaaacccattagctgcctggattctttctactcaagctgcctttaagccaaagtcttccactggtgctaaggattgggctacttccatggaccgtcaattagaattattcagatggttacaaactccagaaggttgtattgctggtggtgccactaactcatggcaaggttcttacgctcaaccatccagtgatatcactaccttctacggtatgtggtacgactggcaaccagtttaccacgacccaccatccaacaactggactggtatgcaaggttggggtatggaacgtgtctgttccttatactacgtttccggtgatgaaagagctggaaaggtttgccaagaatgggccaagtgggttaaggacactactcgtgtcagtggtggtgaaattgttcacgctactaaccttgactggtctggtaacccagatgaatggaattcttccaacttcaacaagtctaaccttaaccgttcccttcacggaactgtttcttccgaaggtgttgatcttggttccatcgcttctatcattaagggtttaatgtgggtttctatgagagatggtgaccaagaaggtattaacctttctattgaagttatggatgccattgaaaactacaaggatgatcttggttacgctgctgaagaacaacgtcttgactacgaaaagttcggtggagaagtttacattccatctggctggactggtaagaatgctcaaggtgccaacattaagagtggtgttactttcattgatatccgtccaaagtacaagcaagatccagattgggctcaagttgaagaataccttaacggtggtaacccaccagaattcaactaccacagattctgggctcaaactgaaattgctgttgctaacggtcttatttccatttatgg

SEQ ID NO: 27042 - DNA, 606 bp, Piromyces finnis
  Six-hairpin glycosidases
catgtactacctttctggtaacgaaaaggctggtcttgtctgtaagaactgggctcaatgggttaaggacactactcgtgttaacggtggtgaagttatccacgctactaacttaggttgggatggtaatccagatgaatggaaggcctctaacttcaataagtctggtcttaacaaatctcttcacggtactgttacttctgaaggtcttgatcttggttccattgcctctattatgaagggattaatgtgggtttctatgaaggatggtgatgaagaaggtctttctcttgctgtttctgtcatggatgccattgaaaactacaaggatgatcttggttacgctgctgaagaacaacgtcttgactacgaaaagttcggtggagaagtttacattccatctggctggactggtaagaatgctcaaggtgccaacattaagagtggtgttactttcattgatatccgtccaaagtacaagcaagatccagattgggctcaagttgaagaataccttaacggtggtaacccaccagaattcaactaccacagattctgggctcaaactgaaattgctgttgctaacggtcttatttccatttatgg

SEQ ID NO: 27043 - DNA, 1074 bp, Piromyces finnis
  Six-hairpin glycosidases
ttacttaggtaagactgatgaagaaattcaaaagaagcttgatgaactttggaatcactatttcaagggtgataacaacagtaaggtattttatgaccaaggtaacgaaggttacattttagatgtaaacaataatgatgttcgttctgaaggtatgtcttacggtatgatgatcgctgttcaaactgatcaccaaaaagaattcgacaaactttggaactgggctaagaaccatatgtggcacaagagtggtagttgggatggttatttcgcctggaagcgtggatcaaacggttctggtggtgatgataactgtgctccagatggtgaaatgtacttcatgatgtcattactttttgccgctaaccgttggaatgacaagaaatacatggacgatgcccaatacattcttaagagaatgtgggataacagtcaacacagtctcttcaacccagcttacaatgttattactttccaaccacaaggtaatgaaaacaatttctctgatccatcctacgatttaccagctttcgtagatctcttctctcgttggtctactactaaccaaaataaatggaaggctgctgcttctgccactcgtgatcacttatacaaatcttccaacccacaatctggtttattctctgactacaataactttgatggtactccacactctgttagttacaacagtaacgctcaaaagtacatgtacgatgctatgcgttgtgctatgaactttggtatggattactatttattcggtactgatgctaagcgtcaaactgaaatggccaaacgtatcatcaaccactttgaaaaggatggttaccaacacgctcgtttcaactgggatggtactggtggatctgaacaatacactttaggtgaaactggtgctaacgctgttgccacttatgctttaatgggaattgctggttacgaagacattattaagaagaacttaaagatggcttgggatggtaaaccaatgactggtcaataccgttactacgatggtttagttcactacttatctatgcttcatcttcttggtagtttcaagatctggaa

SEQ ID NO: 27044 - DNA, 609 bp, Piromyces finnis
  Six-hairpin glycosidases
catgtactacctttctggtaacgaaaaggctggtcttgtctgtaagaactgggctcaatgggttaaggacactactcgtgttaacggtggtgaagttatccacgctactaacttaggttgggatggtaatccagatgaatggaaggcctctaacttcaataagtctggtcttaacaaatctcttcacggtactgttacttctgaaggtcttgatcttggttccattgcctctattatgaagggattaatgtgggtttctatgaaggatggtgatgaagaaggtctttctcttgctgtttctgtcatggatgccattgaaaactacaaggatgatcttggttacgctacctacgaagaacgtcttgactacgccaacttcggtcaagaaacttacattccatctggctggagtggtaagaacgctcaaggtgccaacattaagagcggtgctactttcattgacattcgtccaaagtacaaggaagatccagattgggctcaagtcgaagacttcctcaacggaggtaacccaccagccttcacttaccacagattctggggtcaaaccgaaattatggttgccaatggtcttatctctatttacgattt

SEQ ID NO: 27045 - DNA, 1887 bp, Piromyces finnis
  Six-hairpin glycosidases
gcgtgctagcgatgaatacggtagacgtgttactgatctttacgatgttatgactggtaatggttcttacagttctgaatacttctctgctgaaaaggttccataccactctgttgaaactcttatggttgaagctccagatcatggtcacgaatctgtctctgaaaccttctctttctggatttggttagaagctgttaacggtaagatcactggtaactacgatggtgtcgaagaagcctggaactacttagaaaagcacattattccagacagcaagaaccaaccaggtaacagtaagtacaacccatcttccccagctacttacgctgctgaacacgatgatattgatggttacccatctaaacttatcttccaagatggtattgttggtgaagatccaattgctaaggaactttctcaagcctacggtaactgggatatctacatcatgcactggattattgatggtgataactggtacggttatggtcaacaaggtgatggtacttctaagccatctttcattaacaccttccaacgtggtgcttccgaatctacttggaagactgttccacacccatgttgggaagccatgaagtggggtggtcgtaacggtttcttagatcttttcactgttgataactcctacgctaagcaatggagatacactgctgctccagatgctgatgctcgtgctgttcaagctgcttacttcgcctacatctgggctgaagaagatggtgttaacctttcttctgttgctgctaaggctgccaagcttggtgattacttacgttacgctcaatacgataaatacttcaagaagattggtaactgtgttggttctgacaaatgctctgctggtcgtggtaagaactctgctcactaccttatctcctggtacttcgcctggggtggaggtttacaaggtgactgggcctggagaattggttcttctcacactcacagtggttaccaaaacccattagctgcctggattctttctactcaagctgcctttaagccaaagtcttccactggtgctaaggattgggctacttccatggaccgtcaattagaattattcagatggttacaaactccagaaggttgtattgctggtggtgccactaactcatggcaaggttcttacgctcaaccatccagtgatatcactaccttctacggtatgtggtacgactggcaaccagtttaccacgacccaccatccaacaactggactggtatgcaaggttggggtatggaacgtgtctgttccttatactacgtttccggtgatgaaagagctggaaaggtttgccaagaatgggccaagtgggttaaggacactactcgtgtcagtggtggtgaaattgttcacgctactaaccttgactggtctggtaacccagatgaatggaattcttccaacttcaacaagtctaaccttaaccgttcccttcacggaactgtttcttccgaaggtgttgatcttggttccatcgcttctatcattaagggtttaatgtgggtttctatgagagatggtgaccaagaaggtattaacctttctattgaagttatggatgccattgaaaactacaaggatgatcttggttacgctacctacgaagaacgtcttgactacgccaacttcggtcaagaaacttacattccatctggctggagtggtaagaacgctcaaggtgccaacattaagagcggtgctactttcattgacattcgtccaaagtacaaggaagatccagattgggctcaagtcgaagacttcctcaacggaggtaacccaccagccttcacttaccacagattctggggtcaaaccgaaattatggttgccaatggtcttatctctatttacga

SEQ ID NO: 27046 - DNA, 606 bp, Piromyces finnis
  Six-hairpin glycosidases
catgtactacctttctggtaacgaaaaggctggtcttgtctgtaagaactgggctcaatgggttaaggacactactcgtgttaacggtggtgaagttatccacgctactaacttaggttgggatggtaatccagatgaatggaaggcctctaacttcaataagtctggtcttaacaaatctcttcacggtactgttacttctgaaggtcttgatcttggttccattgcctctattatgaagggattaatgtgggtttctatgaaggatggtgatgaagaaggtctttctcttgctgtttctgtcatggatgccattgaaaactacaaggatgatcttggttactcttcccacgaagctcgtggtgattacgacaagttcggtggtgaagtttacattccatctggttggactggtaagaatgctcaaggtgccaacattaagagtggtgttactttcattgatatccgtccaaagtacaagcaagatccagattgggctcaagttgaagaataccttaacggtggtaacccaccagaattcaactaccacagattctgggctcaaactgaaattgctgttgctaacggtcttatttccatttatgg

SEQ ID NO: 27047 - DNA, 1887 bp, Piromyces finnis
  Six-hairpin glycosidases
gcgtgctagcgatgaatacggtagacgtgttactgatctttacgatgttatgactggtaatggttcttacagttctgaatacttctctgctgaaaaggttccataccactctgttgaaactcttatggttgaagctccagatcatggtcacgaatctgtctctgaaaccttctctttctggatttggttagaagctgttaacggtaagatcactggtaactacgatggtgtcgaagaagcctggaactacttagaaaagcacattattccagacagcaagaaccaaccaggtaacagtaagtacaacccatcttccccagctacttacgctgctgaacacgatgatattgatggttacccatctaaacttatcttccaagatggtattgttggtgaagatccaattgctaaggaactttctcaagcctacggtaactgggatatctacatcatgcactggattattgatggtgataactggtacggttatggtcaacaaggtgatggtacttctaagccatctttcattaacaccttccaacgtggtgcttccgaatctacttggaagactgttccacacccatgttgggaagccatgaagtggggtggtcgtaacggtttcttagatcttttcactgttgataactcctacgctaagcaatggagatacactgctgctccagatgctgatgctcgtgctgttcaagctgcttacttcgcctacatctgggctgaagaagatggtgttaacctttcttctgttgctgctaaggctgccaagcttggtgattacttacgttacgctcaatacgataaatacttcaagaagattggtaactgtgttggttctgacaaatgctctgctggtcgtggtaagaactctgctcactaccttatctcctggtacttcgcctggggtggaggtttacaaggtgactgggcctggagaattggttcttctcacactcacagtggttaccaaaacccattagctgcctggattctttctactcaagctgcctttaagccaaagtcttccactggtgctaaggattgggctacttccatggaccgtcaattagaattattcagatggttacaaactccagaaggttgtattgctggtggtgccactaactcatggcaaggttcttacgctcaaccatccagtgatatcactaccttctacggtatgtggtacgactggcaaccagtttaccacgacccaccatccaacaactggactggtatgcaaggttggggtatggaacgtgtctgttccttatactacgtttccggtgatgaaagagctggaaaggtttgccaagaatgggccaagtgggttaaggacactactcgtgtcagtggtggtgaaattgttcacgctactaaccttgactggtctggtaacccagatgaatggaattcttccaacttcaacaagtctaaccttaaccgttcccttcacggaactgtttcttccgaaggtgttgatcttggttccatcgcttctatcattaagggtttaatgtgggtttctatgagagatggtgaccaagaaggtattaacctttctattgaagttatggatgccattgaaaactacaaggatgatcttggttactcttcccacgaagctcgtggtgattacgacaagttcggtggtgaagtttacattccatctggttggactggtaagaatgctcaaggtgccaacattaagagtggtgttactttcattgatatccgtccaaagtacaagcaagatccagattgggctcaagttgaagaataccttaacggtggtaacccaccagaattcaactaccacagattctgggctcaaactgaaattgctgttgctaacggtcttatttccatttatgg

SEQ ID NO: 27048 - DNA, 1074 bp, Piromyces finnis; identical to SEQ ID NO: 27043
  Six-hairpin glycosidases

SEQ ID NO: 27049 - DNA, 843 bp, Piromyces finnis
  Six-hairpin glycosidases
ccatatgtggcacaagagtggtagttgggatggttatttcgcctggaagcgtggatcaaacggttctggtggtgatgataactgtgctccagatggtgaaatgtacttcatgatgtcattactttttgccgctaaccgttggaatgacaagaaatacatggacgatgcccaatacattcttaagagaatgtgggataacagtcaacacagtctcttcaacccagcttacaatgttattactttccaaccacaaggtaatgaaaacaatttctctgatccatcctacgatttaccagctttcgtagatctcttctctcgttggtctactactaaccaaaataaatggaaggctgctgcttctgccactcgtgatcacttatacaaatcttccaacccacaatctggtttattctctgactacaataactttgatggtactccacactctgttagttacaacagtaacgctcaaaagtacatgtacgatgctatgcgttgtgctatgaactttggtatggattactatttattcggtactgatgctaagcgtcaaactgaaatggccaaacgtatcatcaaccactttgaaaaggatggttaccaacacgctcgtttcaactgggatggtactggtggatctgaacaatacactttaggtgaaactggtgctaacgctgttgccacttatgctttaatgggaattgctggttacgaagacattattaagaagaacttaaagatggcttgggatggtaaaccaatgactggtcaataccgttactacgatggtttagttcactacttatctatgcttcatcttcttggtagtttcaagatctggaa

SEQ ID NO: 27050 - DNA, 1677 bp, Piromyces finnis
  Six-hairpin glycosidases
taccggtgattactctggtgttgaaactgcctggagctacattgaaaagcacatgattccagacagcaagaaccaaccaggtaacagtaagtacaacccatcttccccagctacttacgctgctgaacacgatgatattgatggttacccatctaaacttatcttccaagatggtattgttggtgaagatccaattgctaaggaactttctcaagcctacggtaactgggatatctacatcatgcactggattattgatggtgataactggtacggttatggtcaacaaggtgatggtacttctaagccatctttcattaacaccttccaacgtggtgcttccgaatctacttggaagactgttccacacccatgttgggaagccatgaagtggggtggtcgtaacggtttcttagatcttttcactgttgataactcctacgctaagcaatggagatacactgctgctccagatgctgatgctcgtgctgttcaagctgcttacttcgcctacatctgggctgaagaagatggtgttaacctttcttctgttgctgctaaggctgccaagcttggtgattacttacgttacgctcaatacgataaatacttcaagaagattggtaactgtgttggttctgacaaatgctctgctggtcgtggtaagaactctgctcactaccttatctcctggtacttcgcctggggtggaggtttacaaggtgactgggcctggagaattggttcttctcacactcacagtggttaccaaaacccattagctgcctggattctttctactcaagctgcctttaagccaaagtcttccactggtgctaaggattgggctacttctcttgaccgtcaattagaattattcagatggttacaaactccagaaggttgtattgctggtggtgccactaactcatggcaaggttcttacgctcaaccatccagtgatatcactaccttctacggtatgtggtacgactggcaaccagtttaccacgacccaccatccaacaactggactggtatgcaaggttggggtatggaacgtgtctgttccttatactacgtttccggtgatgaaagagctggaaaggtttgccaagaatgggccaagtgggttaaggacactactcgtgtcagtggtggtgaaattgttcacgctactaaccttgactggtctggtaacccagatgaatggaattcttccaacttcaacaagtctaaccttaaccgttcccttcacggaactgtttcttccgaaggtgttgatcttggttccatcgcttctatcattaagggtttaatgtgggtttctatgagagatggtgaccaagaaggtattaacctttctattgaagttatggatgccattgaaaactacaaggatgatcttggttactcttcccacgaagctcgtggtgattacgacaagttcggtggtgaagtttacattccatctggttggactggtaagaatgctcaaggtgccaacattaagagtggtgttactttcattgatatccgtccaaagtacaagcaagatccagattgggctcaagttgaagaataccttaacggtggtaacccaccagaattcaactaccacagattctgggctcaaactgaaattgctgttgctaacggtcttatttccatttatgg

SEQ ID NO: 27051 - DNA, 1887 bp, Piromyces finnis
  Six-hairpin glycosidases
gcgtgctagcgatgaatacggtagacgtgttactgatctttacgatgttatgactggtaatggttcttacagttctgaatacttctctgctgaaaaggttccataccactctgttgaaactcttatggttgaagctccagatcatggtcacgaatctgtctctgaaaccttctctttctggatttggttagaagctgttaacggtaagatcactggtaactacgatggtgtcgaagaagcctggaactacttagaaaagcacattattccagacagcaagaaccaaccaggtaacagtaagtacaacccatcttccccagctacttacgctgctgaacacgatgatattgatggttacccatctaaacttatcttccaagatggtattgttggtgaagatccaattgctaaggaactttctcaagcctacggtaactgggatatctacatcatgcactggattattgatggtgataactggtacggttatggtcaacaaggtgatggtacttctaagccatctttcattaacaccttccaacgtggtgcttccgaatctacttggaagactgttccacacccatgttgggaagccatgaagtggggtggtcgtaacggtttcttagatcttttcactgttgataactcctacgctaagcaatggagatacactgctgctccagatgctgatgctcgtgctgttcaagctgcttacttcgcctacatctgggctgaagaagatggtgttaacctttcttctgttgctgctaaggctgccaagcttggtgattacttacgttacgctcaatacgataaatacttcaagaagattggtaactgtgttggttctgacaaatgctctgctggtcgtggtaagaactctgctcactaccttatctcctggtacttcgcctggggtggaggtttacaaggtgactgggcctggagaattggttcttctcacactcacagtggttaccaaaacccattagctgcctggattctttctactcaagctgcctttaagccaaagtcttccactggtgctaaggattgggctacttctcttgaccgtcaattagaattattcagatggttacaaactccagaaggttgtattgctggtggtgccactaactcatggcaaggttcttacgctcaaccatccagtgatatcactaccttctacggtatgtggtacgactggcaaccagtttaccacgacccaccatccaacaactggactggtatgcaaggttggggtatggaacgtgtctgttccttatactacgtttccggtgatgaaagagctggaaaggtttgccaagaatgggccaagtgggttaaggacactactcgtgtcagtggtggtgaaattgttcacgctactaaccttgactggtctggtaacccagatgaatggaattcttccaacttcaacaagtctaaccttaaccgttcccttcacggaactgtttcttccgaaggtgttgatcttggttccatcgcttctatcattaagggtttaatgtgggtttctatgagagatggtgaccaagaaggtattaacctttctattgaagttatggatgccattgaaaactacaaggatgatcttggttactcttcccacgaagctcgtggtgattacgacaagttcggtggtgaagtttacattccatctggttggactggtaagaatgctcaaggtgccaacattaagagtggtgttactttcattgatatccgtccaaagtacaagcaagatccagattgggctcaagttgaagaataccttaacggtggtaacccaccagaattcaactaccacagattctgggctcaaactgaaattgctgttgctaacggtcttatttccatttatgg

SEQ ID NO: 27052 - DNA, 207 bp, Neocallimastix californiae
  Starch-binding domain-like
cagtgaatccattccaaatcaacaatggcgtcattactccttctggactcatagtatttctggtgtcagtccaaacttcactattaataatgttattccaggtacctatcaattacgtgcttggtctaagggtgttgttggtgaatttatcttaaacaaaactattactgtaactgctggtcaaaccactaatcttggtgaaattgt

SEQ ID NO: 27053 - DNA, 306 bp, Anaeromyces robustus
  Starch-binding domain-like
tgttccaaaagctaaacgtggttccgtatctggtaaattagttattaaagatccattatatggtagtcttaaaatttctgatgcaacagttactttagttcaaccagaaagtagtacagaaccaattcatccacaacaatggcataaaatgtctcactgggttactcatgtcactggtgatttcaaaattgaaaatgtagtaccaggtacttatcaacttagagcttggtctaaaggtattgttggagaattttatactactaataccatcacagtaactagtggacaagaaacaaaacttggtga

SEQ ID NO: 27054 - DNA, 303 bp, Piromyces finnis; identical to SEQ ID NO: 14998
  Starch-binding domain-like

SEQ ID NO: 27055 - DNA, 198 bp, Piromyces finnis
  Starch-binding domain-like
cgaaccaattccaaaccaacaatggcgtcatatgtcattctggactcacagtttatctggtgctacaccaaactttgtaatttacaacgttattccaggtacatatgaattacatgcttgggcaaagggtgttgttggtgaatttgttttagataagttagttaccgttaaagctggtgaagttgttaatcttggaaa

SEQ ID NO: 27056 - DNA, 36 bp, Neocallimastix californiae
  SUBTILASE_ASP
ttatattttagatagtggtatatatggtgaccatat

SEQ ID NO: 27057 - DNA, 36 bp, Neocallimastix californiae
  SUBTILASE_ASP
atatattttagatagtggaatcgatgttcatcatgc

SEQ ID NO: 27058 - DNA, 33 bp, Neocallimastix californiae
  SUBTILASE_HIS
tggttctatggtagcttcggtagctgcgggaaa

SEQ ID NO: 27059 - DNA, 33 bp, Neocallimastix californiae
  SUBTILASE_HIS
tgggagcatggtagcttcaatcgctgctggtaa

SEQ ID NO: 27060 - DNA, 33 bp, Neocallimastix californiae
  SUBTILASE_SER
tacctcattttcttgtccaatagtggctggtgt

SEQ ID NO: 27061 - DNA, 33 bp, Neocallimastix californiae; identical to SEQ ID NO: 27060
  SUBTILASE_SER

SEQ ID NO: 27062 - DNA, 51 bp, Neocallimastix californiae
  SUBTILISIN
cggtacctcattttcttgtccaatagtggctggtgtggccgcttctataat

SEQ ID NO: 27063 - DNA, 42 bp, Neocallimastix californiae
  SUBTILISIN
acttaaattccatggttctatggtagcttcggtagctgcggg

SEQ ID NO: 27064 - DNA, 60 bp, Neocallimastix californiae
  SUBTILISIN
tagaggagtggatatttatattttagatagtggtatatatggtgaccatattgattttga

SEQ ID NO: 27065 - DNA, 60 bp, Neocallimastix californiae
  SUBTILISIN
taaaggagtggatatatatattttagatagtggaatcgatgttcatcatgctgattttga

SEQ ID NO: 27066 - DNA, 42 bp, Neocallimastix californiae
  SUBTILISIN
aataaaataccatgggagcatggtagcttcaatcgctgctgg

SEQ ID NO: 27067 - DNA, 51 bp, Neocallimastix californiae
  SUBTILISIN
gggttcctctttttctgcaccccttgtcgcaggggtggcagcctctataat

SEQ ID NO: 27068 - DNA, 60 bp, Anaeromyces robustus
  SUBTILISIN
aaaaggtattgatatatttttaatagataaaggactttatttagataatgatgattttga

SEQ ID NO: 27069 - DNA, 51 bp, Anaeromyces robustus
  SUBTILISIN
aggtacttcagtatctacagcgattacagcaggagttatagctactattat

SEQ ID NO: 27070 - DNA, 72 bp, Neocallimastix californiae
  Subtilisin-like
tttaagtgcggctgtacaggaaaataataataataataataaattttatattatttctattaaggattccaa

SEQ ID NO: 27071 - DNA, 69 bp, Neocallimastix californiae
  Subtilisin-like
aaaaccaaaatttgttaagaaacaaatgaataaatttgctgaacttattttagatcatatagataccta

SEQ ID NO: 27072 - DNA, 1191 bp, Neocallimastix californiae
  Subtilisin-like
tgttttagatgttaccgtcatctatgcctatctctcggaagaattatataatatcataaaggatttaccagatgtcgtatcctgtaatgaagatgtcgtcattcctttccccaatgatactataatttcaataaatgataccaatacttttgaaattaaatcagacaaaaaatttgagaaaagagcctcctattatgatctttacgacattaaaagggatacaaattggagtgatgttactgtctttgaaaatacttatcatcatttatcgcttatttctcaatctaaatatgatagaaatttagttggaaaatatgatcgaaacttttattatccaatctctgctggtagaggagtggatatttatattttagatagtggtatatatggtgaccatattgattttgataccggtcatcgtacggtgtcctgtgatgcgatgtttggtaaaactcgtgtcatcaatcaacctggctcttctaattataaaaattgttatctagaaaacgaacttaaattccatggttctatggtagcttcggtagctgcgggaaaatattttggtgtagcgaagaatgctaatattcatatgatagttcatgatcgtaccgctttaaatattctttatgcctatgattatgttaaaaaatatgccaaaaatcctcataaaacggtcattaatctttcctttggtaattatattcgtatacctgaagaagaaaaaatgattaattctttagctgaaatgggatttatagtgattgctgccgccggtaatgattatacgaatgcttgtaccaataatcctcgacaagtaaaacaagagggtcaaacagttaccgtcaccagtaaaatgtatcctgcagcgtatagtaacgtcatcgctgttggggccaccaataatgatattcaatcattagatgtgaccaacgttagtaatctttataatgttgcctctttcagtaactatggaaattgtcttgatatttttggtcctggttatgtctatggagcctatcctggatatgattatagaaataacaactctatacaagcttacgctggcggtacctcattttcttgtccaatagtggctggtgtggccgcttctataatttcagaacatcctgaaattgaatttaacgttactattttaagacagtggctattggataatgcagttcggaatat

SEQ ID NO: 27073 - DNA, 168 bp, Neocallimastix californiae
  Subtilisin-like
atatgattatagaaataacaactctatacaagcttacgctggcggtacctcattttcttgtccaatagtggctggtgtggccgcttctataatttcagaacatcctgaaattgaatttaacgttactattttaagacagtggctattggataatgcagttcggaatat

SEQ ID NO: 27074 - DNA, 942 bp, Neocallimastix californiae
  Subtilisin-like
ctattactatccttcttctgcaggtaaaggagtggatatatatattttagatagtggaatcgatgttcatcatgctgattttgaattggatactggtaatactggtaacggttatcgtaccgtgtcttgtgatgctatgtttggtgataaagaaattattaatcaacctggttcctcaagctacaaaaattgcttcttagaagagaaaataaaataccatgggagcatggtagcttcaatcgctgctggtaaaattcatggggtcgctaaaaatgctaatattcatatggtggtgcataaccgacagagtaccggtattctgttggcctataattttgttaaaaacaatcttaaagatcctcataagacggttattaacctatcatttggcagttataaaaaaattccagaagaggtatcattaattaattcgttaattgaaatgggatgtatcgtggttgcagctgggggtaatgataacatcagcagttgtaccacggaacctagatatgttgtttcggatgacgataataaggtaaaaaccctaatacaggaaaagatttatcctgcttctctggaaaatgtcattggcgttggatcaatacgtaacaaaattaaagaaacggatgtttcaagtgttcagaacttgtatagccttgctgattttagtaattatggggattgccttgatctatttgctcctggttatgcctatgccgcctatccaccacccaataataacgataaaagttcttctgatttggaaggctacggcgggggttcctctttttctgcaccccttgtcgcaggggtggcagcctctataatttcagaacatccagaaatgacatttaatcattccctaatgaaaaaaatgcttctggaaatttctgtggagggtattctcgatcaatctggaatccatgatagtcccaataattt

SEQ ID NO: 27075 - DNA, 102 bp, Neocallimastix californiae
  Subtilisin-like
tttgtttaatttattagtaatttattgtgttttcagctatgctgaaaaagaaaatttaaaaaaaacgaataaatattatatcatttccattaaagattccaa

SEQ ID NO: 27076 - DNA, 183 bp, Neocallimastix californiae
  Subtilisin-like
tattttggatgtctccgttatctttgcttatctttctgaagagttatatgaaattattaaggagttaccagatgtggtgtcttgcaatgaaaatgtcataattcctttccccaatgataaaattttcagtattaccaatatggaaagtataggaagtatggaaagtatggaaaaggataaatc

SEQ ID NO: 27077 - DNA, 162 bp, Anaeromyces robustus
  Subtilisin-like
aattttaaattattatactattttagtttatctttctgacgaacttgttgatcaagttcaagctttaccaaatgttataagttgtgaaaaatcatttaaaattcaagaccaagtatataaagaagaggaagaaattttaattaataataataataataataa

SEQ ID NO: 27078 - DNA, 993 bp, Anaeromyces robustus
  Subtilisin-like
tgaaaatgatgattctcatttatctttattatctcaaggtagattttataaagaagtcacaggaagatatgataataattattattatccttcttctgcaggaaaaggtattgatatatttttaatagataaaggactttatttagataatgatgattttgatagatatgaaggaacagaggatgaacgtacattaacgtgtgatgctttagttgtttatggtgtagctcatccttatgaaggtgaagataaaaagaaatgtaaatttgctgaagatagttatccaggtcatggtaatatggtttcttccttagcaggaggaaaattatacggtgcagcaaaaaaggcaaatttacatatgattgtttcttattatgaattatatgaaactattgtagcattagattatatcaaacaaaatggtaaaccttatcaatccattattagtttttctcgaggagcttataaaaaatatagtcaatttttacaagataaattagatgaattaaatgatgcaggatttattactgttgttgctgctggtaatgaaacggaagatatatgtcatgaaaaaaataaatatttttattctatagcaggctataaaaatgtaattattgtaggttcaacagaatcaacttacaataatgatattgaaaatggttataaaattgcttcttactcaaattatggggaatgtattgatatttttgctccaggtcaagccagatatgcaaattatcaattaaatagaaaagcacaaggtacttcagtatctacagcgattacagcaggagttatagctactattatgtccgaacatcctgacattaaatttaatgtagatactatgaaagaaaaattatttgaattatcattaaaaaatattattagtggattaaataatgttacaccaaatagatttttaaataatggtaaacttagtattatatcacctattcattattataatactactgttactacccctac

SEQ ID NO: 27079 - DNA, 744 bp, Neocallimastix californiae
  Thioesterase
ccttatcccagctgctggtagttccattaatatgtataatagttggagtaagtatatgaataagtctgctttattcgctattagttatccaggtcacttggcccgtatagatgaaactccaattgatgactttaaagtattggttaagtctattggtgaagaaattttaaataatattaagaatggtaaaatttcaaaggataaaccaatttacttctttggtcattccttaggtgccttagtttcctatgaaacagttttatatcttcaaaatgaaagaaagaagggtaatccaaatgctccagttgttactgctttagttgtcagtgcttctccatctccagttttcccaagaccaattactattaaacatgacgaaaatggtaatccagttcattttactgatttagctccagaggaattaccagcatttttaactaatcttggtggtgctaataaggatagtatgagcaataataaacaattccaaaaattaattccatccattgttgccgatttcaaattaactgatgaatacagacgttttactgataaggatcatcaattagaatgtgctctttatgatattggtggtattagtgatccaattatttctgttgcatcaagatctcgttgggatcttgaaaatgctgaaggttatccaatagttcgtattgaatttgaaggtgaccactggttcattcaagaaaatgtagaagttgttcttgaacgtttaaagaagga

SEQ ID NO: 27080 - DNA, 729 bp, Anaeromyces robustus
  Thioesterase
acttttcccagctgctggtagttctattaatatgtatagtaattggaataaatatttaactaattctactttacttgctgtaagtttaccaggtcatttaattcgtttagaagaaaaaccaattgataatatggaagatttagtggataatatttataaggaaattataaagaatgttaaaaatggtaatattccaaaggatcaaccattatatttatttggtcattctttaggtgctttagttggttatgaagtagctatgactcttcaaaatgaaagaaagaaaggtaatccagatattccaaatattactgctttaatttctagtggttctccagctccaattttcccaagaccagttgttattcgatatgaaaatgataaaccaattcatttcactgatttagttccagaacaatacccagaagaattaagtagacttggtggtgctaatagtgaaagtttacaaagtaaacaattccaaaaattaattccatctattgcagcagatttcatacttactgataattataaacgttttagtgaaaaagatcatcaattagaagttccaatttatgatattggtgctaattctgattatgttgctccaaaggatagtagaactaattgggatattgaaattgctaatggatacccattgaaacgtatgaatttcgaaggtggtcattggttcattcaagataatcttgaagttgttatggattattt

SEQ ID NO: 27081 - DNA, 744 bp, Piromyces finnis
  Thioesterase
ccttttcccagctgctggtagttctatcagtatgtatggtaattggaacagttacatgaaaaactcagccttatttggtgttagttatccaggtcatttagtacgtttagatgaaactccaattgatgacttaaagactttagttagtgctattgctaaagaaattatggaaaatattaagaatggtaatattccaaaggatcaaccactttactgttttggtcactccttaggtgctcttgtttcatatgaagttgtaatgcttcttcaaaatgaaagaaagaatggtaatccaaatgccccagtctttgctggtcttattgtaagtgcatctccagctccaatttatccaagaccaattcctcttcgtaaggttaatggtaaaccaattcactttactgatttatcaccagaacaattcccagaagaattagctattcttggtggagctaacaaagaaagtttacaaagtaaacaattccagaagttaataccatctattgcagctgatttcaaaattactgataattacaaacgtattactgataaggatcatcaattagaatgtccattatatgatattggtggtgtttctgatccaatggttaacccagattctagaaagaattgggaacttgaagtaactgaagaaactccattagttcgtattacttttgaaggtggtcattggtttattcaagaaaatatggaatctgttcttgaacgtttaaagaaggaacttaa

SEQ ID NO: 27082 - DNA, 360 bp, Neocallimastix californiae
  Thioesterase/thiol ester dehydrase-isomerase
tattccaaagagaaaacctgatgctattgttaaagaacgtacttctgaagatcaagctattctttatcgtttatctggtgataagaatccattacatgttgatccagctatggcttctattgccggttaccattcaccagttttacaaagtctttgtgttttagctatcagtactcttcatatcattcaaaccttctgttatggtgatgtcgccagtattaaatctattcaagctgattttgtttcacatgtattcccaggtgaaactttacaaactaatatgtggcaagatggtacaaagattttattcaatgttaaggccttagaaagagatgttattgttatctctaatgctgctgt

SEQ ID NO: 27083 - DNA, 405 bp, Neocallimastix californiae
  Thioesterase/thiol ester dehydrase-isomerase
atttgctaaggaacacttcaactacaatgaaagagatgttatcttatattcaattggtgttggtatcaccaaaaaggaactatcctatgtttatgaaaattcacctgatttcaaggttcttccaaccttctccactgttccagctatggactatttctcaaaaatgaaccttgctaatgttttaccaatattttcaccagaagctttaatacaaacaaagcattatatggaattaaataaaacattcgaaccaaaagataatgttgtttcaaaaggtaaaattgttgatatcataaagactaagatgggtgctgttttaattactgctatctctacatatgataaagatggtaatgaaatttgttataatgaattccaacatcttcttcgtcatgttgataaata

SEQ ID NO: 27084 - DNA, 360 bp, Neocallimastix californiae
  Thioesterase/thiol ester dehydrase-isomerase
tattccaaagagaaaaccagatgctattgttaaggaacgtacttctgaagatcaagcaattctttaccgtttatctggtgaaaaaaatccattacatgttgatccagctatggcttctattgctggttatcattccccagttttacaaagtctttgtgttttagctatcggtacactacatattattcaaaccttctgttatggtgatgttgccagtgttaaatcaattcaggcagatttcgtttcacatgtattcccaggtgaaactttacaaactaatatgtggcaagatggtactaaaattttatttaatgttaaagctttagaaagagatgtcattgttatctctaatgctgcagt

SEQ ID NO: 27085 - DNA, 414 bp, Neocallimastix californiae
  Thioesterase/thiol ester dehydrase-isomerase
tgaatttgctaaggaacgtttcaactacaatgaaaaagatgttatcttatattctcttggtgttggtattactaagaaggaactttcttatgtttatgaaaattcaccagatttcaaggttcttccaacgttctccactgttccagctttagactacttctctaaaatgaatcttagtaatattttaccaatattttcaccagaagctttaatacagaccaagcactacatggaattaaataaaacatttgaaccaaaggataatgttgtttcaaagggtagaattattgatattataaaaagcaagatgggagctatcttagttactgctatctctacttatgatgaagaaggtaatgaaatttgttacaatgaattccaacatcttcttcgtcatgttgataactatgatca

SEQ ID NO: 27086 - DNA, 333 bp, Neocallimastix californiae
  Thioesterase/thiol ester dehydrase-isomerase
cactaatgaagattactctcttgcctctggtgatgtaaatccaattcacactaactactactttgctaacttggctgatcttgatgttccaattactcacggtatgtggactagtgctgctactcgtcgttatgttgaaacctatgccgctgataatgatgctgaacgtgtcgtttcctacaaggttaactttataggtatggtttctccaaaggatgaacttcgtaccagccttactcatgttggtatgcacaatggtagaaagatcattaaggtttccgtcaaggacttacgtactaacgaaaccgttatggaaggtgaagctgaagttaa

SEQ ID NO: 27087 - DNA, 351 bp, Neocallimastix californiae
  Thioesterase/thiol ester dehydrase-isomerase
tgtcaccgaagaagatgtgaagttcttctctgatgttacccgttacactcatccatccaacaaggttgttccatccatggactttatcattgttacctcctgggtttctgtcttcaagactatctttgccaaggaatttgatgctgatatcacacgtttagtccacatgaacaacggttatgaagtcattgatccacgtccattacgtattggtgaagttgttgatactcgttccatcatttctgctgttactaaccttgactctggtaagttaattgaggttactggtcatgtcttcagagaaggtaaggaatacgttaaggttacctctagcttcttatgtcgtggtaa

SEQ ID NO: 27088 - DNA, 336 bp, Neocallimastix californiae
  Thioesterase/thiol ester dehydrase-isomerase
tcactcctctaacattggatactcccgtgtctccggtgatgttaatccaattcatactaacccatactttgctcaattagctgatcttccaggtaacattactcacggtatgtggactagtgcctctactcgtaagtttgttgaaacctttgctgctgaaaaccatccacatcgtgttacctcttatgaagttaaattcttagatatggtcttcccaggtgatcgtttagaaaccaagcttttccatactggtatggctaatggtaagaaaattattcaatgtaagacgatcaaccaagatggtaaggtggttcttgaaggtactgctgaagttga

SEQ ID NO: 27089 - DNA, 339 bp, Neocallimastix californiae
  Thioesterase/thiol ester dehydrase-isomerase
cattattggtaatcgtgctgaatcttacactgaccgtggtcaaaaggtcttatttgctccaatggatttcgctattgttgttggttggcagagtattatccgtgctatcttcccaaaattcatcaatgccgatttattaaagttggttcatttaactaacggattccgtatgattgataatgaatctggtttaaaggaaggtgatattgttaagactgaatctcgtattattagtgttattaatgatgaaactggtaagattgttgaagttaagggtgtcttaaagcgtgatgaaaagccatttatggaagttatttctaagttcttctaccgtggtgt

SEQ ID NO: 27090 - DNA, 336 bp, Neocallimastix californiae; identical to SEQ ID NO: 27088
  Thioesterase/thiol ester dehydrase-isomerase

SEQ ID NO: 27091 - DNA, 339 bp, Neocallimastix californiae; identical to SEQ ID NO: 27089
  Thioesterase/thiol ester dehydrase-isomerase

SEQ ID NO: 27092 - DNA, 339 bp, Neocallimastix californiae
  Thioesterase/thiol ester dehydrase-isomerase
tattattggtaatcgtgctgaatcctacactgaccgtggtcagaaggttttatttgcaccaatggatttcgctatcgttgttggttggcaaagtattatccgtgctatcttcccaaaattcatcaatgccgatttattaaaattggttcacttatctaacggtttccgtatgattgataatgaattaggattaaaggaaggtgatgtcgttaagactgaatctcgtattattagtgttgtcaatgatgaaactggtaagattgttgaagttaagggtgtcttaaagcgtgatgaaaagccattcatggaagttatttctaagttcttctatcgtggtat

SEQ ID NO: 27093 - DNA, 339 bp, Neocallimastix californiae
  Thioesterase/thiol ester dehydrase-isomerase
cactcactcttccaacttaggatactctcgtgtttccggtgatgttaacccaatacacactaatccatactttgctcaattagctgatcttccaggtaacattactcacggtatgtggactagtgcttccactcgtaagtttgttgaaacctttgctgctgaaaaccatcctcaccgtgtaacttcctatgaagttaaattcttagatatggtattcccaggtgatcgtttagaaactaagctcttccatactggtatggctaacggtaaaaaaattattcaatgtaagacgatcaaccaagacggtaaggttattcttgaaggtactgctgaggtgga

SEQ ID NO: 27094 - DNA, 351 bp, Neocallimastix californiae
  Thioesterase/thiol ester dehydrase-isomerase
tgttaccgaagaagatgttaagttcttctctgatgttactcgttacactcatccatctaacaaggtcgttccatccatggactttatcatcgttacctcctgggtttctgtcttcaagactatctttgctaaggaattcgatgctgatattactcgtttagttcacatgaacaatggttatgaagttattgacccacgcccattaaagatcggagaactcgtcgatactcgttccatcatttctgctgttactaaccttgactctggtaagttaattgaagttaccggtcatgtcttcagagaaggtaaggaattcgttaaggttacctctagcttcttatgtcgtggtaa

SEQ ID NO: 27095 - DNA, 333 bp, Neocallimastix californiae
  Thioesterase/thiol ester dehydrase-isomerase
cactaacgaagattactctcttgcctctggtgatgttaatccaattcacaccaactactactttgctaacttggctgatcttgatgttccaattactcacggtatgtggactagtgccgctactcgtcgttacattgaaacctatgccgctgataatgatgctgaacgtgtcgtttcctacaaggttaactttattggtatggtttctccaaaggatgaacttcgtaccagccttactcatgttggtatgcacaatggtagaaagatcattaaggtttccgttaaggacttacgtactaacgaaaccgttatggaaggtgaagccgaagttaa

SEQ ID NO: 27096 - DNA, 360 bp, Anaeromyces robustus
  Thioesterase/thiol ester dehydrase-isomerase
tatcccaaaaagaaaaccagatgctattgtaaaagaacgtacttctgaagatcaagctattctttatcgtttatctggtgataagaatccattacatgttgatccagctatggcttccattgcaggttatcattctccagttttacaaagtttatgtgttttagctattagtactcttcatattattcaaaccttctgttatagtgatgttgctagtattaaatctgttcaagctgattttgtttcacatgtattcccaggtgaaactttacaaactaatatgtggcaagatggtactaaaattttattcactgttaaagctttagaaagagatgttattgttatttccaatgctgctgt

SEQ ID NO: 27097 - DNA, 414 bp, Anaeromyces robustus
  Thioesterase/thiol ester dehydrase-isomerase
tgaattcccaaaagaacgtttccaatatagtgaaagagatgttattttatattctcttggtgttggtattactaagaaagaactttcttatgtttatgaaaattcaccagatttcaaggttcttccaaccttttcaacggttccagctatggattatttctcaaaaatgaatcttgctaatgtattacctgttttctcaccagaatctttaatacaaactaaacattatatggaattaaataaaattttcgaaccaaaagattgtgttgtttctactggtaaaattgttgatattataaaaactaaaatgggtgctgtattaattactgctattaccacttacgatcaagatggtaatgaaatttgttataatgaattccaacatcttcttcgtcatgttgataattatgatca

SEQ ID NO: 27098 - DNA, 333 bp, Anaeromyces robustus
  Thioesterase/thiol ester dehydrase-isomerase
taccaatgaagattattctcttgcctctggtgatgttaatccaattcacaccaactattactttgctaatttagctgatcttgatgttccaattactcatggtatgtggactagtgctgctacccgtcgttatgttgaaacctatgctgccgataatgatgctgaacgtgtcgtttcctacagagttaactttattggtatggtatcaccaaaggatgaacttcgtactagtcttactcatgttggtatgcataatggtcgtaagattattaaggtttccgttaaggatttacgtaccaatgaaaccgttatggaaggtgaagctgaagttaa

SEQ ID NO: 27099 - DNA, 354 bp, Anaeromyces robustus
  Thioesterase/thiol ester dehydrase-isomerase
acgtgttactgaagaagatgttaaattcttctctgatgttactcgttacactcatccttctaataagattgttccatccatggactttattattgttacttcctgggtttctgttttcaaaactatttttgctaaggaatttgatgctgatattactcgtttagttcatatgaataatggttatgaagttattgatccacgtccattacaaattggagaaattgtagatactcgttctattatttctgctgttactaatttagattctggtaaattaattgaagttactggtcatgtctttagagaaggtaaggaattcattaaggtcactagtagtttcttatgtcgtggtaa

SEQ ID NO: 27100 - DNA, 339 bp, Anaeromyces robustus
  Thioesterase/thiol ester dehydrase-isomerase
tactcactcctctaaccttggttattcacgtgtttctggtgatgtcaatccaattcatactaatccatactttgctcaattagctgatcttccaggtaacattactcatggtatgtggactagtgcttctactcgtaagtttgttgaaactttcgctgctgaaaatcatccacatcgtgttacttcttatgaagttaaattccttgatatggttttaccaggtgatcgtttagaaactaaacttttccatactggtatggctaatggtaagaagattattcaatgtaagaccattaatcaaaacggtcaagtcattttagaaggaactgctgaagttga

SEQ ID NO: 27101 - DNA, 339 bp, Anaeromyces robustus
  Thioesterase/thiol ester dehydrase-isomerase
tattattggtaatcaagctgaatcttacactgatcgtggtcaaaaggtcttatttgctccaatggatttcgctattgttgtaggttggcaaagtattattcgtgccatcttccctaaatttattgatgctgatttattaaaattagttcatttatctaacggtttccgtatgattgaaaatgaaactggtttaaaggaaggtgatgttgttaagactgaatctcgtattattagtgttgttaatgatgaaactggtaagattgtagaagttaagggtgtcttaaaacgtgatgaaaaaccattcatggaagttatttctactttcttctatcgtggtat

SEQ ID NO: 27102 - DNA, 339 bp, Piromyces finnis
  Thioesterase/thiol ester dehydrase-isomerase
tattattggtaaccaagctgaatcctacaccgaccgtggtcaaaaggttttatacgctccaatggatttcgctattgttgttggttggcaaagtataattcgtgccattttcccaaagtttattaatgctgatttattaaagttagttcatctttctaacggtttccgtatgattgataatgctactggtttaaaggaaggtgatattgttaagactgaatctcgtattattagtgttattaatgatgaaaatggtaagattgttgaagttaagggtgttcttaagcgtgatgaaaagccatttatggaagttatttctaaattcttctaccgtggtgt

SEQ ID NO: 27103 - DNA, 336 bp, Piromyces finnis
  Thioesterase/thiol ester dehydrase-isomerase
tcactcctctaaccttggatactctcgtgtatcaggtgatgttaacccaatccacactaatccatactttgctcaattagctgatcttcctggtaatattactcatggtatgtggactagtgcctctactcgtaagtttgttgaaacatttgctgctgaaaatcatccacaacgtgttacttcttatgaagttaatttcttagatatggttttcccaggtgatcgtttagaaactaaactttaccatactggtatggctaatggtaagaagattattaaatgtaaaactattaatcaaaatggacaagttattcttgaaggtactgctgaagttga

SEQ ID NO: 27104 - DNA, 336 bp, Piromyces finnis; identical to SEQ ID NO: 27103
  Thioesterase/thiol ester dehydrase-isomerase

SEQ ID NO: 27105 - DNA, 339 bp, Piromyces finnis; identical to SEQ ID NO: 27102
  Thioesterase/thiol ester dehydrase-isomerase

SEQ ID NO: 27106 - DNA, 336 bp, Piromyces finnis; identical to SEQ ID NO: 27103
  Thioesterase/thiol ester dehydrase-isomerase

SEQ ID NO: 27107 - DNA, 339 bp, Piromyces finnis; identical to SEQ ID NO: 27102
  Thioesterase/thiol ester dehydrase-isomerase

SEQ ID NO: 27108 - DNA, 339 bp, Piromyces finnis; identical to SEQ ID NO: 27102
  Thioesterase/thiol ester dehydrase-isomerase

SEQ ID NO: 27109 - DNA, 336 bp, Piromyces finnis; identical to SEQ ID NO: 27103
  Thioesterase/thiol ester dehydrase-isomerase

SEQ ID NO: 27110 - DNA, 357 bp, Piromyces finnis
  Thioesterase/thiol ester dehydrase-isomerase
tccaaagagaaagccagacgctattgttaaggaacgtacttctgaagatcaagccattctttaccgtttatctggtgaaaagaacccattacacgttgatccagctatggcttccattgctggttacaattcaccagttttacaaaacctttgtgttttagccatcagtactcttcatgtcattcaaaccttctgttatagtgatgttgctagtgttaagtctattcaagctgactttgtttctcatgtcttcccaggtgaaactttacaaactaatatgtggcaagaaggtaccaagatcttatttaccgtcaaggctttagaaagagatattgttgttatttctaatgctgctat

SEQ ID NO: 27111 - DNA, 405 bp, Piromyces finnis
  Thioesterase/thiol ester dehydrase-isomerase
atttaacaaggaaaagttttcttacagtgaaagagatgttatcttatattcccttggtgttggtattaccaaaaaggaactctcttacgtttatgaaaattctccagacttcaaggttcttccaaccttctccaccgttccagccttagactacttctccaagatgaacctctctaacatattaccaatctttactccagaaaccttcatacaaaccaaacactttatggaattaaaaaagattttcgaaccaaaagatgttgttgtttcaaagggtaaaattgttgacataataaaaacaaaactaggtgctgttttagttactgctatatccacttatgatcaagatgataatgtcatttgttataatgaattccaccatcttcttcgtcacgttgatcacta

SEQ ID NO: 27112 - DNA, 381 bp, Neocallimastix californiae
  Thiolase-like
agttgctgttgttggtattgctttaagacttccaggtggtatcaataccgttgataagtattggaagagtttagaaaatggtagattttgtgtctctccaacaggtactaaccgtcatcttcaccataacatgactcacaatgaggaactaaaaccaggagaacattacattttcaactactgtcgttatgatagtactccagatgcagctcctatcactgattttgatccaatgttctttaatatgaatccaaatgaagccactgttcttgatccaaagttccgttgggtcttagaaactacttatgaagttttacaagatgctggtattaacccagattctctctctggtactcatactaatatttacactgcccctgg

SEQ ID NO: 27113 - DNA, 681 bp, Neocallimastix californiae
  Thiolase-like
tgcttctgcttccttaccaggtagaattagtttcatgtataatttatttggtgctgctcacaccgtagatactgcctgttcttccggtttagttgctatccatgatgcttttaaggatttgaatattggtgaaactgatcttgccattgtgaatgctgctcactgtccattccaaagttcttctttcagtcttttatcaatagcaaaaatggtttccagaaactgtagatgtgcttcttacgatgaagcagcagatggttacgttccaggggaaggttgtgtttccgttattttaaagagaaaggatgatgccattcgtgatcataataagatttatggtttaattaatgctactgctgtcggtcaaagtggttccagagcttctatgagtactccaacggttctcggtcaaaagtacattcataaaaaggtccttgaaaaggctaatcttactccaggagatattgattatatggaaggtcatggtactggtaccaaattgggtgatcgtattgaagctgaagctattaatgaagttttcaagggtactcactctgagagccgtccattaaccttagctagtgtaaagactaacattggtcacactgaagaagttagtggtttagcttctttggttaaggttttattagcaatgaagcataagaccgttcctcctcatct

SEQ ID NO: 27114 - DNA, 393 bp, Neocallimastix californiae
  Thiolase-like
ggttccaattgctgttgttggtatgggtcttcgtttaccaggtggtattaatactccttctaaatattggaatgctttagttaatggtaaggattgtatttcaccaactcctgctaaccgtcatcttcaccaatatttaaggccattttgcccaccaaatgaattaggcccatttgatcactatattcatcgtgctggttattatgatgttactccagatgctgccccaatttctgattttgatccaactttctttaatatttctccattagaagctaaattcactgaaccaaaattccgttggatctatgaaactgtttatgaagctttccaagatgcttgtataaatgtttctgaattaaatggaactcgtacttctgtttttactactgt

SEQ ID NO: 27115 - DNA, 678 bp, Neocallimastix californiae
  Thiolase-like
tgctgcttctagttgtgctggtcgtatttccttcaactatggttttattggtccatctgatactattgatactgcttgttctagtggtttaaatgattgtcacaatgcttgtaaatcactttctatgggtgattctgatgtagctgttgtttctgctgttcaccaacaatttgtatctactcaattccatgttatttctgttgctcatatggcttcacaaattggtcgttgtgctacttttgatgctgaagctgatggttatgctcctggtgaaggttgtattagtattattcttaaacgtttagatgatgctgtaactgatcatgatcatatttatggtgttattactggtattactacttcacaatctggtattagaccatctatttcttctccagcggttggtccacaagttgagaatattcaaaaagctttacaaattgctaatgtttctccagctgatgttgattatgttgaagctcatggtactggtacccaagttggtgatgctattgaaactgaaactttaaacatagcctttggtggtactcacaatgctaagaagccattaattgtaggtagtgtaaagactaacataggtcacactgaagaagtttctggtttagctggtttatgtaaggttcttttatctatgtctcatcgtactattccaccaca

SEQ ID NO: 27116 - DNA, 1125 bp, Neocallimastix californiae
  Thiolase-like
aaaatttgctattattggtattggttgtcatttcccagaaggtatagagtcaaaggaagctttctggaaaatgttagaagatgctcgttgtatcacaaaggatatacccaaggatcgatgggataaaaatgaatggtattctaaggaacctattcaaggtacaattcaaactaaacgtggagccttcctaaaaaacccatatcttttcgataataagtatttctatatctctatgccggaagctaaagaaatgtcaccggaacaacgttggcttttagagttaactgtagaaaccttagaagatgcaaacattaaacctgaagctgtccgaggatcacgtacgggtgtcttcattggatcttctggttgtgattatttagccactcaaatttctcatgccaatgatattaattctcattctcctactggatttgaactttctattttagctaaccgtttatcctatgtttttgatttacaaggaccctccattagttgtaataccgcttgttcttctgcattttctgctttaaatatcggtttaaatgctatgattacggatgattgtgaaatggctctcgttgctggttctaattttatgaattgtccaggtggatttgtggccttctctcaacttcgtgtcgtttctcctgacggttcctgtaaaccttttgatgaaaaggctaacggttatgccagattagaaggagctggtatggtattaattaaaccctatgaaaaggccgttcgtgatggtgataaaatttattgtgctatcgttggttgtggtagtaatgaggatggtcgttctccctccctgactatgccatcctatgaagcccaatataagcttttaagtcatgtttgtgaaaaatcaggcatacttccatcagaaattgattatgtggaggcccatggtactggtactaaagtaggagatccaattgaatcccatgccattggagatgcctatggtcgtagtaaaggggttcgtggaccaaatgatccccccgtcctcgtaagttcagtcaagggtaacacaggccatggtgaaaattcgagtggtattgttagtatcataaagacctcattgatgctccataaacgtaaattagtacccaccgt

SEQ ID NO: 27117 - DNA, 1152 bp, Neocallimastix californiae
  Thiolase-like
cagtaataaaaagattgcaatcattggtatggcttttcgtttacctggagctattagtaattctaaatcattatggatggctttagctaaaagtagggattgcatcttacctccagtgaaaactagagatttacatcatggctatgtgaataagccagccaatcaattaggccccaaggaacactaccttgctcgtgtgggttgttacgatgttcgtcctaacgtggctaaaccttcagaattcgatgcagacttctttaactgttcaccggaagaagctactgctcttgatccaagacatcgttggatcttagaaacgagttgggaagctttagaaaatgctggtattgtaccaagctcgcttaaaaataccatcactggagtctttgtcggtatgaacaatgatcatgaacatgaagatctattaaagaaatgtggtaaagttccaccgttagccgctcatgccaccgctcaaagtagtattgccggtcgtctcagctatttctatgaactctttggtccttcctacaccatcgataccgcctgttctacaggttcctctgcccttcattctgcttgtcagtctatgcaatgtggggactgtgatctttctatcgtttctggcgtaaagtatatgtattccagtgatgaattccataagacttgtgcggctcgtatgacttcgccgaatagtcgttgtgctacctttgacgccagtgccgatggtttcgctcaaagtgaaggttgtgtgacctttgttttaaaacgtcttgaggatgccattcgtgataaggataacatcttatcggttatcctgggttccagtagtggtcaaagtggtttaagacaatccattagtgctccttcctcggaaggtcaaagaattacgattcagagagccatgaaggtcgccggtatcactccagatcaagtctcctatgtagaggctcatggtacgggtacccccttaggggatgccatcgaggttcatgcgctcaatcaagtctacgccggtagtcacacggaagaaaatccattagttgttggtagtattaaatctaatattggtcatacctgtgaagctgctggtttagcaggtatcgctaaggttattgtggccatgaagcataatactattccaaagaatattca

SEQ ID NO: 27118 - DNA, 960 bp, Neocallimastix californiae
  Thiolase-like
gtatgctgttattggtgttggttgtcgtttcccaggtaatattaaatctaaggaagatttctgggaaatgcttacttcaggtcgttgtcttacttcagaaataccaaatgatcgatggaatactgcggaatggtataacaaggaaccaaagagaggtactatgcaaaccacaagaggtgcttttatggaagatgcattctattttgataataaatacttctctatttctcaaaatgaagctaaagaaatgtctcctgaacaacgttggttaatggaattagcagttgaaacctttgaagatgctaacatcaatccaaagaaattaaagggttcaagaactggtgtatttgtcggctcttctggtatggactttgtttcagcccaaatttctcatgctaatgatttaactcaacattccgctactggtctagaactctcaattcttgctaatcgtatttcttacttctttgatttgaatggtccatccatttgtactaatactgcttgctcagcttcaatgaccgccttaaatcttgctattaattcaatgattactgatgattgcgatgctgcactcgttgctggaactaatttattatttactccaggtagttatgttgcttattctcaacttcgtgttgtttccactgatggttcatgtaagccattcgataagaatgctgatggttattcacgtattgaaggtgctggtatgattttaattaagccatatgaaaaagctgttaaggatggtgataagatttactgtgctattttaggtagtggtactaatgaagatggtcatactccatcattaactatgccatcttacagttctcaatgcaagttattaacacatgtttgcgaaaaatttgatattgatccagcttcaattgattatgttgaagctcatggtacaggtactgcagttggtgatccaattgaagctcgttccattgg

SEQ ID NO: 27119 - DNA, 105 bp, Neocallimastix californiae
  Thiolase-like
cccattacttattggttcaagtaagggtaatactggtcatggtgaatattcaagtggtattattgggatgattaaggctatcttaatgttataccaccgtactat

SEQ ID NO: 27120 - DNA, 60 bp, Neocallimastix californiae
  Thiolase-like
tttacgtattgctgttaattcttttggttttggtggttccaatggtaatgctattttcga

SEQ ID NO: 27121 - DNA, 198 bp, Neocallimastix californiae
  Thiolase-like
tgttgttaccggttacggtgaagttggtccatacggtaacactcgtactcgttgggaaatggaagctgatggtaagttctctcttgaaggttgtgttgaattagcctggattatgggattcatcaaacatgttacctataagcaaatgccagatggtaccttatactctggttgggttgatgctaagtctggtgctcc

SEQ ID NO: 27122 - DNA, 639 bp, Neocallimastix californiae
  Thiolase-like
attaccaaccggttgggatccagctcgttacggtattccaaaagatatcattgaacaagttgatatcattacctgctactgtattgtctctgctgttgaagccttagttagtgctggtattactgatccatacgaattctacgaatacgtccacgtttctgaagttggaaatgcctgtggttctggtgttggtgctgaacttgccaaccgtgctatcttcaaggaccgtttccttgacaagccacttcaaagtgatattcttcaagaaaccttcgttaataccatgagtgcctggattaacttattattactttcttcctctggtccaattcgtaccccagttggtgcctgtgcctctgccgttgaatctgttgatatcggtattgatactattttatctggtaaggctaaggttgtctttgtcggtggttatgatgacttccaagaagaaggttcctatgaattcgctcaaatgaaggctacctctaactctcgtgaagaaatggctcaaggtcgtgaaccaaatgaaatgtctagaccaactgcctcctctcgtggtggtttcatggaagctcaaggtgttggtacacaagttttaatgccagctagccttgctcttaagatgggtgttccaatcta

SEQ ID NO: 27123 - DNA, 1146 bp, Neocallimastix californiae
  Thiolase-like
ttctgataaaatcgccattattggtatggcattacgtttaccaggtactatcaataattctaaatcattatggatgtcattagccaaaggaagagattgtgttttgccaccagttaaaactagagatttacatcatggttatgtcaacaaatcatttaatgagttaggtccagatgaacactatcttcctcgaattggatgttatgatactcgtagtaatgctgctaaaccttcagaattcgatgcctcgttctttaactgtactgctgaagaagctatctcattagatcctagacatcgttggatcttagaaacaagttgggaggcattagaaaatgcaggtattgctccaaattctttagaaaatactttaaccggtgtctatgtcggtattaataatgaacatgaacatgaagatctattaaaggaatgtggtatcgttccacctgttgcttcccataccttaaatcaaagtagtattgcgggacgtttaagctatttctataaactttttggtccatctttcactatcgatacggcctgctctactggttcttctgcacttcatactgcttgtagagctatgcaatatggtgaatgtgatctatctattgttactggtgtaaaatacatgtattcctccaaggaattccataaaacatgttctgcccatatgacttctccaaacggtcgttgtgctacgtttgatgaaagtgcagatggatttgctcagagtgaaggttgtgttacttttattttaaaacgtcttgatgatgctattcgtgataacgacaatattttaactgttattcttagttctgttagtggtcaaagtggtttcagacaatccattagtgctccttcctatgaaggacaagctattaatattgaaagggcaatgaaaattgctggaatcaagccagaacaagtttcttacgttgaagctcacggtacaggtaccccattaggtgatgctattgaaattcatgctcttaataaagtttatggtggtagtcatacggaagaaaatcctttaattgtcggaagtattaaatcaaacattggccatacctgtgaagctgctggtttagccggtattgcaaaggtcatcgtttccatgaaacataatcttattccaaagaatat

SEQ ID NO: 27124 - DNA, 501 bp, Neocallimastix californiae
  Thiolase-like
tgttggtataattggtttagcatcttatattccaagtactaccgtaaatatgtctaagttagaagttcatgataattgtcaaggtaaatatacaattagtcttggtcaaaagtatatgtctttaactgctccaaatgaagatgtagtttctatggccttaaatgctgtgaagcgtttaatgaaaaagatgaacttaaagccaagtgatattggaagaattcaaattggtacagaaactcctgtagatttaagtaaaagtgtgaagacatttattgttgaacaattctttgatcaaggtattactgatattgaaggtgttgataatgttaatgcttgctttggttctactgcagctttattcgatactgttgcttggatgcaaagtgaattttggaatggtagatatgctattgttgttggaactgatatttcacaaggtgaagatatttatcacttccttacaggttcttccgctgttgctgtcttaattggcccaaatgc

SEQ ID NO: 27125 - DNA, 1113 bp, Neocallimastix californiae
  Thiolase-like
aatagctattattggtgttggttgtcgtttaccaggtgatattttaaccaaagatgatttttggaatatgttagtaacaaaacgtgttgtcacaactgaaattccagctgatcgttgggatcgtgatgaatggtatagtgatgagcctattccaggtactattcagacgaaacatggtggtttccttactaatgcttatgattttgataataaatatttttctatttctcaagctgaagctcttgaaattactccagaacaacgttggttatgtgaacttgctgttgaaactatggaagatgctaatattcgcccagaagaattaaaaggtagtcaaacaggtgtttttgttggttctgctggtattgattttggtggtaaccaattagttaatacattacaaatgtccgctcataccatgacaggtttagaaccatctatcttttctaatcgtatttcttacattttcgatttacatggtccttccattacaagtaatactgcatgctctgcttcaatgtcctctttatctatggcttgcaatgctattgctgttggtgattgtgataaggcttttgttgctggttccaatttcttaccatctccaggtggctatgttgctttctctcaacttagagtagtttctaagactggttcttgtaaaccatttgatgaaaaagcggatggttatgctagacttgaaggtgcttgtatgcttttaattaaagattatgaaaaggctgtaagagataatgataagatttatgcttgtattattggtagtggtactaatgaagatggtcgtacattatctataactatgccatcctcagatgctcaatgtactttaatgaagtgggtttgtgaaaaaagtaatatcaaggcagatactattgattatgttgaagctcatggtaccggtacaccaactggtgatccaattgaagccagatctattggtaatgcctttggtaaggctgttcgtgctccaggtagtaagccacttccagttggtactgttaaaggtaacgttggccatggtgaatttttaagtggtgcaattggtctcttgaaaacttcgttaatgcttttcaataaacaattagttccaac

SEQ ID NO: 27126 - DNA, 63 bp, Neocallimastix californiae
  Thiolase-like
cccattgcgtgctgctgttaattcctttggttttggcggtgctaatgccaatgctattttaga

SEQ ID NO: 27127 - DNA, 708 bp, Neocallimastix californiae
  Thiolase-like
tgaaccaaatcgtggtatatttagtaatagtacttttgatttctataagccttatggatacaagaatcattatccagtagtagatggcaagtattctataaagtgttatcttgattccttaaagagttgctatgaagatcttaagaagaagacaaagtctgaaacagaattccttgatcatcaatttggtgtcttccataattctagtgtttctctaacaagaaaaggtttcaatactttaatggaaatggaaattccaaaggttcttccaaacgctaaagcaattgaaaaaagaaaattcatttcaaagatatataaggaaagagtagaagcttctactttaatgactgctaatatgggctgtatgtataatgcttctgtcttaaatggtattatttcattaaatgaatccttaactccagatgatattggtaaacgtgcattagtttattccttcggttctggttctgttggtgctctctggactttacgtatcgatggtttagctgaaaaggatgatttagttaatagattaagtaatcgaaaagaagtttctgttgatacttatttcgaaatcagaaaattatggcttgaagaaattaaaaagtttggacgttcttacaaaaaagatcaatttgaacttccaattcgtgatggtgattattatttagcaagtgtttcttctaatggtgttcgtaaatatgaaat

SEQ ID NO: 27128 - DNA, 639 bp, Neocallimastix californiae
  Thiolase-like
aattccaactggttggaagccagaaacctatggtattccaaagagtattattgatcaagttgatccaattaccctttatgttattgttgctactgttgaagctttagttagctctggtattactgatccatacgaattttacgaatatgttcatgtttctgaagttggaaactgttctggtggtggtgttggtggtatggtatccaaccgtaagcaatactttgaacgtctctttgaaaagccagttcaaaatgatattcttcaagaatgcttcatcaacactatgccagcttggattaatttattattactttcttcttctggtccaattaagacaccagttggtgcttgtgctactgccgttgaatctgttgaaattggtttagaaactatcttaagtggaaaggctaagattgttattgttggtggttacgatgacttccaagaagaaggttcctatgaatttgctaacatgaaggctaccagtaactccttagaagaattagctcatggacgtgatccatctgaaatgtctcgtccagctactactactagaggtggtttcatggaatctcaaggtgccggtcatgaaattttgatgacagcttctcttgctattaagatgggtgttccaatcta

SEQ ID NO: 27129 - DNA, 180 bp, Neocallimastix californiae
  Thiolase-like
tgttgttgttactggttatggtgaagttggtccatacggtaactcacgtactcgttgggaaatggaagcctatggtaaattctctcttgaaggttgtattgaaatggcctggattatgggtatgatcaagtatgctaagaacaagaagacaaagaatggtaaactctattctggatgggt

SEQ ID NO: 27130 - DNA, 207 bp, Neocallimastix californiae
  Thiolase-like
tccatctgaaatgtctcgtccagctactactactagaggtggtttcatggaatctcaaggtgccggtcatgaaattttgatgacagcttctcttgctattaagatgggtgttccaatctacggtattattgctcatacttccactgctacggataaggaaggacgttctgttccagctccaggtcaaggtatcttaactactgctcg

SEQ ID NO: 27131 - DNA, 411 bp, Neocallimastix californiae
  Thiolase-like
aagaggtgctcttgccgttttcggcttaactattgatgatattgaggcattatctttccatggtactggtacaaaggctaatgatactaatgaatccgaagtcattaacaagcaattcaaacatcttggtcgtagtaagggtaatgtttgtccagccatcatgcaaaagtacttaactggtcatccaaagggtgctgccgcttcttggatgcttaacggtatgcttcaagtcatcgaaactggtatcattccaggtaaccgtaatgccgataatattgaagaaaagcttcgtaaattcgaatacatctacttcccatctcgttccattcatacagatggtattaaggctggtttattaaagtctttcggtttcggtcaagttggtggtgaagttttagttatttctccaga

SEQ ID NO: 27132 - DNA, 1152 bp, Neocallimastix californiae
  Thiolase-like
ttcgatggataaaagagtggcagtgattggtatggctcttcgtttacctggtgccatcaataattctaaatcgttctggatgtctttagccaaaggtagagattgtgtcttggctccagtcaaggatagaaaattacaccttggttatgtggataaaccatctaatcttttaggagaaaatgaacataatattccaaaatgtggttgctacgattctcgttcaaatgcagctaaaccttctgaatttgatgcagaattcttcaactgtttacctgaagaagtcaatagtatggatccaagacaacgttgggtcttagaaacgagttgggaagctttcgaaaatgcaggtattgctccaaataccttagaaaataccaccactggtgttttcgtgggtgtaaatgatgatcatgactatcaagatttattgaaagaaaacggtatcgctcaacctatttcagcacattctactccaagtggtattgctggccgtctcagttacttctataaacttttcggaccttcctttactatcgatactgcttgttctacaggtgcttctgccctccactctgcttgtcgttccttacaatttggagattgtgacttatcagtggtttccggagttaaatatttatattctgcctctgaattccatagaaccagtgttgctcgtatgacctctcctcatggtcgttgtgccacgtttgataaggatgctgatggttttgcaccaggtgaaggttgtgttacgtttattttgaagcgtcttgaagatgctgttcgtgatggagataatattctttcagttatccttggtaccagtagtggtcaaagtggtttaagacaatcgattagtgcaccatcttctgatggtcaagtacttaacttgaagagagcacttaaatttgcaggtgttgatccatctgaagtttcttttgttgaagctcatggtactggtactccacttggtgatgccattgaagttgacgcccttaatcaagtttatggaggtagtcacaccgaagaaaatccattagtgattggtagtgtgaaaacaaacattggacatactaatgaagccgctggtttagctggtatggctaaggtcattttagccatgcaacataaatatattccaaagaatttaca

SEQ ID NO: 27133 - DNA, 66 bp, Neocallimastix californiae
  Thiolase-like
acgtcatagagccgccgtcaactcatttggttttggtggtgctaatgccaacgtaattttagagga

SEQ ID NO: 27134 - DNA, 1113 bp, Neocallimastix californiae
  Thiolase-like
atttgctatcattggtacgggtattcgtttaccaggtgaaattaataataaggatgacttttggaaggtaatgaccgataaaaaggtgatcaccggtctcattccagaagatcgttgggatcgtgaagaatggtatagtaaggtcgaaaagccaggcaccatacaaacccttcatggaggtttcattgaaaatgctttcgatttcgataataaatattttggtatctctcaaaatgaagcgttggacgccactccagaacagagatggctatgtgaattaacggttgaaaccgttgaagatgccaatatggatatggatgattttaaaggaagtcatacgggggtctttgtgggtacctccggtatggattatggtagttatgtcttttctgttcctgaaaaaattactaaatatacgtacagtggtattgaaccttccatccatgctaatcgtgtctcgtatcttttcaatcttcatggtccatcgctttccactaataccgcttgttcctcttccatgaccgccttatccattgcttgtaattcgatggccgctggtgactgtgaaatggctttagttgccggtactaacttcttccaagccccagctaatggagtagcctattcgcaacttcgtgtcgtttcgaagaagggagcctgtcgtccatttgatattggtgctgatggttatgctcgtttagaaggtgccgccatggtcttgttgaagccatatgaaaaggccattaaggataataatcgtatttatgccactattttaagtaccgcttgtaatgaagatggtaagacctcatccttgacaaccccatcctccgaagcgcaatgtcaactgatgaaacgtgtgtacagtaagggccacattgatccttgtaccattgattttgtggaagcccatggtaccggtacctctgttggtgatcccattgaagctcgatccatcggtgaagcctatggtaaggtgaataaggccaatggacatcctttactacccgtaggctcagtgaaaggtaatgtgggtcatggtgaatatttgagtggtatcgttggattaattaagggtgccctcatcctccacaagaataccattgttccaca

SEQ ID NO: 27135 - DNA, 1125 bp, Neocallimastix californiae
  Thiolase-like
atccaatgcgatcgccatcattggtatgggtttacgtcttccaggtgctattaataatgaaaagaccctctggtctgctttagttaaaggtagagattgtgtttccaatattccaaaggatcgtaaactccatgaatcctacgtaaataaaccatctaatgaacttaacccaggagaacataatgttaagaaatgtggttactacgactctcgtacctctggtgaaaaagtttctcaatttgatgctgaattctttaactgtcttccagaagaagccattggtcttgatccaaagcatcgttggattttagaaactagttgggaagccttagaaaatgctggtatctctccagattctcttgaagattccaacactggtgtctttgtcggtatcggtgatcagcaagaccatgcccaattcatgaaggaatgccataggaaaaaggttgtcagttaccacaacagtaatccatctgctattgctggtcgtctcagctacttctacaagctctatggtccttcagtgacagtggatactgcttgttccactggtgccaccgcccttcatacggcctgtcgctccatgatctatggtgattgtcgtctcgccatggtcactgcctctaagtatctcttttacccagaagaatttgaaatgaccagtaaggctagaatgacctctcctaatggtcgttgtgctaccttcgataaggacgctgatggttacgcgcccgctgaaggttgtgttaccttcatcttaaagtgcttagaagatgctgaacgtgataaggatcatattcttggtgttatcttaggaactagtagcggtcaaagtggcttccgtcaatccattagtgttccttcttttgaaggtcaagctagaaacattaagcgtgttatggaaattgctggggttaatccttccgatatctcctacgttgaaactcacggtaccggtaccccatacggtgatgccattgaaattcaaggtataaaccaggtctatgctggttcccatactcctgaacatccattagtcattggtagtatcaagaccaatattggtcataccgctgaaacctctggtttagccggaattgcaaaggttttagtggccatgaagaa

SEQ ID NO: 27136 - DNA, 1149 bp, Neocallimastix californiae
  Thiolase-like
gtctaatggaaaaattgctattattggtatgggtcttcgtttacctggtgctattaacagtgcaaaatctctttggttagctttagctaagggtaaggattgtgttttacctccaattaaaactagagatttacatcgtaattacgttaataagccaagtgatcaattagatccaactgaacacaatattcctcgtttaggtttatacgatactagaaatagtgttgctaagccatctcaatttgatgctaagttcttcaattgtttaccagatgaagccttagctcttgatccaagacatcgttggattttagaaactagttgggaagccttagaaaatgctggtattccaccaaactctttagaaaattcttctactggtgtatttgttggtattaacgatgatcacgaatattctgatttattaactgaatgtggcgttaagagtccaattgctgctcatggtcaaagtccaagtggtattgctggtcgtttaagttacttctatagattatatggtccatccttcactatggatactgcttgttcaactggtgcttctgctcttcatactgcatgtcgttcattacaatgcggtgattgtgatttatctattgtttctggtgttaaattcatgtattcttccaaggatttctacatgacttgttctgctagaatgacttcaccacatggacgttgtgccacatttgataaggatgctgatggtttcgtaccaggtgaaggttgtgttaccttcatcttgaagcgtttagaagatgctgttcgtgacaatgatcacatcttatctgttgttttaagtactagtagtggtcaaagtggtttaagacaatctattagtgctccatcctcagaaggtcaagctattaatatgcgtaaggctatgaagtttgctggtattaaaccagaagatgtgtcatatgttgaagctcatggtactggtacaccattgggtgatgctcttgaagttcatgccttaaacgaaatttacggtggtagtcatactgaagaaaatccacttgttgttggtagtatcaagactaatattggtcacacttgtgaaactgctggtttagctggtattgctaaggtcattgtttcaatgcaacacaaacatattccaagaaacct

SEQ ID NO: 27137 - DNA, 207 bp, Neocallimastix californiae
  Thiolase-like
tccatcggaaatgtctcgtccaggtacgactactagaggtggtttcatggaatcccaaggtgctggacatgaaatcttgatgaccgcctctcttgctattaagatgggtgttccaatctacggtatcattgctcacacttctactgctacggataaggaaggacgttctgttccagctccaggtcaaggtattttaactactgctcg

SEQ ID NO: 27138 - DNA, 411 bp, Neocallimastix californiae
  Thiolase-like
aagaggagctcttgccgtctttggtttaactatggatgatattgatgctctctctttccatggtacaggtactaaggctaatgatactaatgaatcagaagttatcaacaaacaatttaaacatcttggtcgtagtaagggtaatgtttgcccagctattatgcaaaagtacttaaccggtcatccaaagggtgctgctgcttcctggatgcttaatggtatgcttcaagttatcgaaaccggtattatccctggtaatagaaatgccgataacatagaagaaaaacttcgtaaatttgattacatctacttcccatctcgttccattcatacggatggtgttaaggctggattattgaagtccttcggtttcggtcaagttggtggtgaagttttagttatttcacccga

SEQ ID NO: 27139 - DNA, 654 bp, Neocallimastix californiae
  Thiolase-like
atttgatagaacagttgctggtcaaattccaacaggttggaaaccagaaacctacggtattccaaagagtattattgatcaagtggatccagttaccctttacgttattgttgctacggttgaagccttaattaactctggtattactgatccatatgaattctatgaatatgttcatgtttctgaagttggaaactgttctggtggtggtgttggtggtatgctttcttcccgtaaggaatactttgaacgtgcatttgagaagccaattcaaagtgatattcttcaagaatgtttcatcaatactatgccagcttggattaacttattgttactttcttcatctggtccaattaagactccagtcggtgcctgtgctactgctgttgaatctgttgaaattggtttagaaacgatcttaagtggaaaggctaagattgtaattgttggtggttacgatgacttccaagaagaaggttcctacgaatttgctaacatgaaggctacgagtaacgcattagatgaattagctcatggtcgtgatccatcggaaatgtctcgtccaggtacgactactagaggtggtttcatggaatcccaaggtgctggacatgaaatcttgatgaccgcctctcttgctattaagatgggtgt

SEQ ID NO: 27140 - DNA, 669 bp, Neocallimastix californiae
  Thiolase-like
tgctgctgcttctttaccaggtagaattagtttcatgtataacttgtacggtgctgcccacactgtagataccgcttgttcttccggtttagtagctactcatgatgctttcaaggatttaaacatcggtgaaactgatcttgctatcgttaatgctgctcactgtccatttcaaagtagtggtttcagtcttttgtctgttgctaagatggtttcaagaaattgtagatgtgctgcttacgatgaagccgctgatggatatgttcctggtgaaggttgtgtctccattatcttaaagagaaaagatgatgccatccgtgatcacaacaaaatttatggtttaattaatgctacagctgtcggtcaaagtggttcaagagcttctatgagtacaccatctgctattggtcaaaagatcattcatgaagaagtcttaaagaatgccaaccttactccaaaagatattgactatatggaaggtcatggtactggtacaaaattaggagatcgtattgaaggagaagccatcaatgaagttttcaagggatctcactctgaaagtcgtccattaacattagctagcgttaagactaacattggtcacactgaagaagttagtggtttagcctctcttgttaaggtcttattagccatgaaatacaagaccat

SEQ ID NO: 27141 - DNA, 381 bp, Neocallimastix californiae
  Thiolase-like
agttgctgtggttggtattgctttaagacttccaggtggtatcaacaccgttgataagtattggaaaagtttagaaagtggtagattctgtatctctccaactggtactaatcgtcttcttcatcacaacctgactcacaatgaacacttaaatcctggagaacattatattttcaactactgtcgttacgatagtacttctgacgtttcccctatcactgatttcgatccattgttctttaacatgaatccaagtgaggctaccgttctcgatccaaaattccgttgggtcttagaaactacttatgaagctttccaagatgccggtataaacccggataccctttctggtactcgtactaatgtatataccgctccagg

SEQ ID NO: 27142 - DNA, 408 bp, Neocallimastix californiae
  Thiolase-like
aaatcgtattgctattgttggtataggattacgtcttccaggaggtattaattcaaccaaaaagttctggttttcattaattaaaggtaagaattgcttatcagctacaccaacggatcgcgaacttcatttaggaatggtagatatgagtaagaagccaccggaatatcgactaaataaaaatgaacattatgtttgtagatatggtatttatgattctcattatgcctcatctggagtaaagtacactgattttgatgctaatttctttgactgctctaccgaggaagctattagcatggatgtcaagcagcgttggatgcttgaaacaagttgggaagctttagaagatgccggtatagatccttcctccatcgaaaattctgataccggagtattcataggaat

SEQ ID NO: 27143 - DNA, 660 bp, Neocallimastix californiae
  Thiolase-like
agatctttcatcagtagctggacgaatttcctatttctataagatatacggaccagccatttctatggatactgcatgctcaacaggagctaccgcactacatacagcgtatcgttctatgcaatatggtgaatgtgatttagctattgtatccggggctcgatttctttactacaatgacgaatttattaatacttctcatgctaaaatggcatcaccaaatggacgttgtgccacttttgatgaagatgcggatggatttgcacctgcagaaggttgtgtgaccctcatcttaaaaagactagatagagctgaagaaaataatgataatatttatggtatacttctaggtagtagtaatggacaaagtggaggacgtcaatccatttctgttccatcttctgaagctcaagttcgtaatattaaaaatgcattaaaagatgctcatgtatctccaaaagatatatcgttcgttgaagcccatggtaccggtaccccttatggtgatgcaatagaaattcatgccttaaatcaaattttcaaagattcacattccaaaaaatcacccttatatattggaagtgtcaaaactaacataggacatacctgtgaagcagctggattagccggtattgttaaagtcttactctccatgaagca

SEQ ID NO: 27144 - DNA, 660 bp, Neocallimastix californiae; identical to SEQ ID NO: 27143
  Thiolase-like

SEQ ID NO: 27145 - DNA, 408 bp, Neocallimastix californiae; identical to SEQ ID NO: 27142
  Thiolase-like

SEQ ID NO: 27146 - DNA, 414 bp, Neocallimastix californiae
  Thiolase-like
taatcataatcgaattgctatagttggtataggattacgtcttccaggtggcatcaattcaaccaaaaaattctggcattcattattacaagggaaaaattgtttatccactacacctgttgatcgtcaacttcacctgggaatgatagatatggctaaacaacaacctggatataaattaaataaaaatgaacactatattcacaaatatggttattatgattcaattcatacggcttctatagcaaagcctacaaagtttgatgctaatttctttgaatgtactaatgaagaagctattggaatggatgttaagcaacgatggatgctggagactagttgggaagctttagaagatgctggtattgatccttcaactcttgaaaattcaaatacaggtgtatttattggaat

SEQ ID NO: 27147 - DNA, 660 bp, Neocallimastix californiae
  Thiolase-like
tgatctttcttcagctgcaggtcgtatttcttatttctataagttatatggcccagcaatttccatagatacagcatgttcaacaggagctacagcattgcatactgcctatcgatctatgcaatatggtgattgtgatctagcaatagtttcaggtgctcgattcctttactataacgatgaatttattaatatttctcatgctaagatgacttcacctaaaggacgttgtgcaactttcgatgaaagtgctgatgggtttgcacctgccgagggttgtgtaacattaattttaaaaagacttgatgatgctgaagaaagtaatgatgacatttatggtattctccttggtagtagtaatggtcaaagtggaggacgtcaatcaatttctgttccttcctcagaagctcaagtacgtaatattagaaatgcactaatggatgctcaaatctctccaaaggacatttcatacattgaagcccatggtactggaactccatatggtgatgcgttggaaattcacgctttaaatcaagtttttggagaaagccatactaaaaattcaccattgtatattggtagtgtgaaaactaatataggacatacctgtgaagcagcagggttagcaggaattgttaaagttttactatccatgaaaca

SEQ ID NO: 27148 - DNA, 678 bp, Neocallimastix californiae
  Thiolase-like
ggaagctttagaaaatgctggtattgctccaaattctctagaaaatactttaactggtgtctatgtcggtattaataatgaacatgagcatgaagatttattaaaaaaatgtggtatcgttccaccccttggttcccataccttaaatcaaagcagtattgctggtcgtttaagttatttttataaactttttggtccatccttcaccattgataccgcttgttccacaggttcttctgctcttcatattgcttgtaatgctatgaaacgtggagaatgtgatttatctattgttacgggtgtgaaatatatgtactcctccaaagaatttcataaaacctgttctgcccatatgacttctccaaagggtcgttgtgccacttttgacgccagtgctgatggttttgctcaaagtgaaggttgtgttacttttgttttgaaacgtttggatgacgctattcgcgataaagataatattttaacagttattcttggttcagttagtggtcaaagtggtttaagacaatcaattagcgctccttcctacgaaggtcaagctctcaacatcgaaagagcaatgaaaattgcaggtatcagtccagatcaagtatcctatgttgaagctcatggtactggtactcccttaggagatgctattgaaattcatgccctgaatga

SEQ ID NO: 27149 - DNA, 207 bp, Anaeromyces robustus
  Thiolase-like
accagatgaaatgtctagaccaaccgcttcctctcgtggtggttttatggaatctcaaggtgttggtactcaagttttaatgccagctagtttagccttaaagatgggtgtaccaatttatggtattattgctcatagtgctactgctacggataaggaaggacgttctgttccagctccaggtcaaggtattttaaccacagctcg

SEQ ID NO: 27150 - DNA, 408 bp, Anaeromyces robustus
  Thiolase-like
acgtggtgctttagccgcctttggtcttactgttgatgatattggtgttgcttccttccatggtacaggtacaaaggctaatgataagaatgaatcagatgtctttaataaacaatttgaacatttaggacgtactaaaggtaatgcttgtccagttgtatgtcaaaagtatcttactggtcatggtaagggtgctgctgctgcttggatgttgaatggtgttattcaaattattcaaactggtattattccaggtaatcgtaatgctgataatattgatccacttttagaaaagtttgatcatctttggttcaataataaaactttcaaaactccaggtgttaaagctggtttattaaaatcctttggttttggtcaagtaggtggtgaaattttagttattcatcc

SEQ ID NO: 27151 - DNA, 198 bp, Anaeromyces robustus
  Thiolase-like
tgtcgttaccggttatggtgaagttggtccatttggtaattgtcgtacacgttgggaaatggaagctgaaggtaaattctctttagaaggatgtgttgaattagcttggattatgggattcattcaacatgttacctataaacaaatgccagatggtaccttatactctggttgggtcgatgctaaatctggtgcccc

SEQ ID NO: 27152 - DNA, 639 bp, Anaeromyces robustus
  Thiolase-like
attaccaaccggttgggatccagctcgttatggtattccaaaggatattatagaacaagtagatccaattacatgttattgtattgtttctgctgtagaagctttagttagtgcaggtattactgatccttatgaattttatgaatatgttcatgtttctgaagtcggaaatgcttgtggttcaggtgttggtgctgaaattgctaatcgtgctattttcaaggatcgtttcttggataaaccacttcaaagtgatattcttcaagaaacctttgttaatactatgagtgcttggattaatttattattactttcctcttctggtccaattcgtactccagttggtgcttgtgcctctgctgttgaatctgttgatattggtattgataccattttatctggtaaggctaaggttgtctttgttggtggttatgatgatttccaagaagaaggttcctatgaatttgctcaaatgaaggctacttctaattcacgtgaagaaatggctcaaggtcgtgaaccagatgaaatgtctagaccaaccgcttcctctcgtggtggttttatggaatctcaaggtgttggtactcaagttttaatgccagctagtttagccttaaagatgggtgtaccaattta

SEQ ID NO: 27153 - DNA, 1125 bp, Anaeromyces robustus
  Thiolase-like
tagtaataaaattgctattattggtatggctttacgtttaccaggagctattaataatgctaaatctttctggatggctttagctaaaggtaaagattgtatttctacaccagttaaagatagaaaattacatcttggttatgtgaataagccatcccatcttttaaatgaaaatgaacataatattcctcgttgtggttgttatgattcacgttcaaatgttgctaaaccttctgaatttgatgcagaattctttaattgtcttccagaagaagctatggctcttgatccaagacatcgttggatattagaaacaagttgggaagctttagaaaattcaggtattgcaccaaattcattagaaaataccattactggtgttttccttggtataaatgatagtcatgattatcatgatttaatgaaagaaaatggtattacaccacctattgctgcccattctacaccaagtggtattgttggacgtcttagttatttctataaattatttggaccttctttcacgattgataccgcttgttctactggtgcttctgctttacattctgcctgtcgttcattacaatttggagattgtgatttatctattgtttccggtgttaaatatttatatacttcaaatgatttccatagaacaagtattgcacgtatgacttcaccaaagggaagatgtgctacttttgataaagatgctgatggatttgttccaagtgaaggatgtgttacttttattcttaaacgttatgaagatgctattcgtgatcatgataatattctttctgttatattaggtactagtagtggacaaagtggtattagacaatctattagtgccccatcttcagatggacaagttattaatttaaaaagagctcttcattttgctggtgtcgatccatccgatatttcatttgttgaaactcatggtacaggtacaccacttggggatgctattgaagttaatgctttaaatcaagtttataaaggaactcatacttctgagaatccattaattattggtagtgttaaaactaatattggtcatacaacagaagttgcaggtttagcaggtgttgctaaagttattttatctatgcaacataa

SEQ ID NO: 27154 - DNA, 1125 bp, Anaeromyces robustus
  Thiolase-like
tagtaataaaattgctattattggtatggctttacgtttaccaggtgctattaataatgctaaatctttctggatggctttagctaaaggtaaagattgtgttactacaccagttaaagatagaaaattacatcttggttatgtggataagccttcacatcttttaggtgaaaatgaacataatattcctcgttgtggttgttatgatacacgttcaaatgttgctaaaccttctgaatttgatgctgaattctttaattgtcttccagaagaagctatggctcttgatccaagacatcgttggatattagaaacaagttgggaagctttagaaaattcaggtattgcaccaaattcattagaaaatacaattactggtgttttccttggtataaatgatagtcatgattatcatgatttaatgaaagaaaatggtattacaccacctattgctgcacattctacaccaagtggtattgttggacgtcttagttatttctataaattatttggaccttctttcactattgataccgcttgttccactggtgcttctgctttacattctgcttgtcgttcattacaatttggagattgtgatttatctattgtttcaggtgttaaatatttatatacttcaaatgacttccatagaacaagtattgcacgtatgacttcaccaaagggaagatgtgctacttttgataaagatgctgatggatttgctccaggtgaaggatgtgttacttttattcttaaacgttatgaagatgctattcgtgatcatgataatattctttctgttatattaggtactagtagtggacaaagtggtattagacaatctattagtgccccatcttcagatggacaagttattaatttaaaaagagctcttcattttgctggtgtcaatccatccgatatttcatttgttgaaactcatggtacaggtacaccacttggtgatgctattgaagttaatgctttaaatcaagtttataaaggaactcatacttctgaaaatccattagttattggtagtgttaaaactaatattggtcatacaacagaagttgctggtttagcaggtgttgctaaagttattttatctatgcaacataa

SEQ ID NO: 27155 - DNA, 1125 bp, Anaeromyces robustus
  Thiolase-like
taaatttgctattattggtataggttgtcatttccctgaaggtatagaatcaaaagaagatttttggcaaatgcttgaagatgctcgttgtattaccaaagatataccaaaagaaagatgggataaagatgaatggtattctgaggaacctattcaaggtactattcaaacaaaacgtggtgcctttttaaagaatccttatctttttgataataaatatttctatatttctatgccagaagctaaagaaatgtcaccagaacaacgttggcttttagaattaactgtggaaactttagaagatgctaatataaaaccagaaactttgaaaggtactcgtactggtgtttttattggttcttctggttgtgattatttagctacacagatttctcatgctaatgatattaattctcattctcctactggatttgaactttcaattttagctaatcgtttatcctatgtatttgatttacaaggtccatcgattagttgtaatacagcatgttcttctgcgttttcagcattaaatattggtttaaatgctatgattactgatgattgtgaaatggcgcttgtagctggttctaatttcatgaattgccctggtggatttgttgctttttctcaacttcgtgtagtatcacctgatggttcttgtaaaccatttgatgaaaaagccaatggttatgctagattagaaggtgcaggtatggtattaattaaaccttatgaaaaggcagttcgtgatggggataaaatttattgtgctattgttggatgtggaagtaatgaagatggtcgttcaccttcccttactatgccatcttatgaagctcaatataaacttttaactcatgtttgtgaaaaatcgggtattcatccaactcaaattgattatgtagaagctcatggtacaggtacaaaagtaggtgaccccattgaatcacgggctattggtgatgcttatggtaaaagtaaaggtattcgtggtccaaatgatccaccaattttaattagttctgttaaaggtaatacaggacatggtgaaaattctagtggtatagtaagtattattaaaacttctatgatgcttcataaacgtcgtctcgtacccactgt

SEQ ID NO: 27156 - DNA, 1149 bp, Anaeromyces robustus
  Thiolase-like
agaaaaaattgctattattggtatgtctttacgtttaccaggttcaattaatagtgctaaatccttctggatggctttagctaaaggtaagaattgtgttttaccacctgttaaaaatagagatttacatcatggttatgttaataaaccaagtgatcaattaaatccaggggaacataatattccatatattggttgttacgatactagatctaatgttgcaaaaccatcccaatttgatgctgaattctttaattgtttaccagatgaagcattagcacttgatccaagacatcgttgggtattagaaactagttgggaagcattagaaaatgcaggtattccaccaaattcattagaagattcacttacaggagtatttgttggtatgagtcaagatcatgaatatgctgatttattagctgaacgtaatattatagctcctattgctgctcattctaatactcaaagtggtattgcaggacgtttaagttatttctatcgtttatatggtccatcattaactatggatactgcctgttctactggtggatcagctattcatactgccgttcgttccttacaaaatagagattgtaatttatccattgtttcatgtgtaagatacatgtatacctccaagactttctataaaacatgtgctgcaagaatgacatctcctcatggacgttgtgcaacatttgataaagatgctgatggatttgcttctggtgaaggatgtgtttgtttcgttttaaaacgtttagatgatgctattcgtgataatgatcatattttaagtgttattataggtactagtagtggtcaaagtggtttaagacaatccattagtgctccatcctccgaaggacaagctataaatattaaaagagctatggaaattgcagatattaaaccagaagatgtttcctatgttgaagcccatggtacaggtacaccattaggtgatgcattagaaattcattccttaaatcaagtttatgctggtagtcataatgaagaaaatccattagttgttggtagtgttaaaactaatattggacacacaggtgaagttgccggtttagctagtattgctaaagttattttagctatgcaacataaacatattcctaagaatcttcattt

SEQ ID NO: 27157 - DNA, 387 bp, Anaeromyces robustus
  Thiolase-like
aattgcagttattggtatgggtattcgtttaccaggtggtattaatacccctggaaaatattggtctgctttagttagtggtagagattgtacatcaccaacaccaactaatcgtcaccttcaccactatttaaaaccaggatgtccagccaatgaattaggaccaatggaacattatatccatcgtggtggtttctatgataccactccagatgctgctccacttagtgattttgatccaacttttttcaacatttcaccattagaagctaaagctacagatccaaaatttcgttgggtttatgaaactgtttatgaagcttttcaagatgcatgtattaatatatctgaattaaatggatctcgtactagtgtttattgtactgt

SEQ ID NO: 27158 - DNA, 684 bp, Anaeromyces robustus
  Thiolase-like
aagtaatccttctagttgtgctggtcgtattgcttttaattatggtttcaccggtccatctgatactattgataccgcttgttcaagtggtttaaatgatgttaacaatgcttgtaaggccctttcttgtggtgatactgatttagctgttgtttcagctgttcatcaacaaattattggtactcaatttcatgttatttctgttgctcaaatggcttctcatcttggtcgttgtgctactttcgatgctgaagctgatggttatgctccaggtgaaggatgtattagtcttattcttaagcgtttagacgaagctgttactgatcatgaccgtatttatggtgttattactggtatttctacagctcaatcaggtactagacgttctatttctactccagctgttggcccacaagcagaaaatatgagaagagttttatctatggctaatattaatgcatctgatgttgattatcttgaagctcatggtactggtactccagtaggtgatgctattgaaactgaaactttaaatcttgttttcggtaaaactcataccgaaaagaaacctttaattgttggtagtgttaagactaacttaggtcacacagaagaagtttctggtttagctggtttatgtaaagttcttttatctatgtcacatcgtataattccaccacatct

SEQ ID NO: 27159 - DNA, 669 bp, Anaeromyces robustus
  Thiolase-like
tgcttgtgcttctttaccaggtagaattagttttatgtataacttatatggtgctgcccatacagttgatactgcttgttcttctggtttagttgctgctcatgatgcttttaaagatttaaatattggtgaaactgatcttgctattgttaatgccgctcattgtccatttataggtagtggtttcagtcttttatctattgctcaaatggtttctagaaattgtagatgtgctgcttatgatgaagctgctgatggttatgttccaggtgaaggttgtgttaccgtcattttaaagagaaaagatgatgctattcgtgatcataataagatttatggtttaattaatgctgctgctgttggtcaaagtggttccagatcttctatgagtactccaactgttgaaggtcaatctagaattcataaggaagttttaaaattagctcatcttgaaccaaaagatattgattatatggaaggtcatggtacaggtacaagtttaggtgaccgtattgaaggtgaagctattaaccttattttcaaaggtactcactctgaaactcgtccattaactttagctagtgttaaaaccaatattggtcatactgaagaagttagtggtttagcttctcttgttaaagttttattagctatgaaaaataagactgt

SEQ ID NO: 27160 - DNA, 381 bp, Anaeromyces robustus
  Thiolase-like
agttgcagttgttggtattgctttaagacttccaggtggtataaatacagttgataaatattgggatgttttagttaatggaaaattctgtgctactccaactggtactaaccgtcatcttcatcattatatgactacagctgaacatttaaaaccaggagaacattatgttactaaatattgtcgttatgatagtactccagatgcagctccaataactgattttgatccaatgttctttaatatgaatccaagtgaagctgctgctcttgatccaaaattccgttgggttttagaaactacatatgaagctttacaagatgcttgcattaatccagattctctttctggtactcgtactaatatttatactgcaccagg

SEQ ID NO: 27161 - DNA, 639 bp, Anaeromyces robustus
  Thiolase-like
aattccaacaggttggaaaccagaaacttatggtgttccaaagaatattattgatcaagttgatccaattaccctttatgttattgttgctactgtagaagcacttgttagttctggtattactgatccatatgaattctatgaatatgttcatgtttctgaagttggtaattgttctggtggtggtgttggtggtatggtttccactcataaagaatactttgatcgtgcttttgaaaaaccagttcaaagtgatattcttcaagaaagctttattaatactatgccagcttggattaatcttttattactttcttcttcaggtccaatcaagactccagttggtgcttgtgctactgctgtagaatctgtagatattggtgttgaaaccattttaagtggtaaggctaagattgttattgttggtggttatgatgatttccaagaagaaggttcttatgaatttgctcaaatgaaggctactagtaattcattagatgaattagctcatggtcgtgatccatctgaaatgtctcgtccagctactactactagatctggtttcatggaagctcaaggtgctggtcatgaaattttaatgaaagctagtcttgctattaagatgggtgtaccaattta

SEQ ID NO: 27162 - DNA, 216 bp, Anaeromyces robustus
  Thiolase-like
tattgttgttactggttatggtgaagtaggtccatatggtaattcacgtactcgttgggaaatggaagcctatggtaaattctctcttgaaggttgtattgaaatggcatggattatgggtatgattaaatatgccaagaataagaagactaaagataataagatgtattctggttgggttgatactcaaaccggtgaaccagttcaagattatga

SEQ ID NO: 27163 - DNA, 207 bp, Anaeromyces robustus
  Thiolase-like
tccatctgaaatgtctcgtccagctactactactagatctggtttcatggaagctcaaggtgctggtcatgaaattttaatgaaagctagtcttgctattaagatgggtgtaccaatttatggtattattgctcatacttctactgctactgataaggaaggacgttctgttccagctccaggtcaaggtattttaactactgctcg

SEQ ID NO: 27164 - DNA, 405 bp, Anaeromyces robustus
  Thiolase-like
aagaggtgctcttgctgtctttggtttaactattgatgatattgatgccttatctttccatggtactggtactaaggctaatgatactaatgaatctgaagttattaataaacaatttaaacatcttggacgtagtaaaggtaatgtttgtccagctattatgcaaaagtatttaactggtcatccaaagggtgctgctgcttcatggatgcttaatggtatgcttcaagttattgaaactggtattattccaggtaatcgtaatgctgataatattgaagaaaaacttcgtaagtatgaatatatttgttacccatcacgttcaattcatactgatggtgttaaggctggtttattaaaatccttcggttttggtcaagttggtggtgaagttttagttattgc

SEQ ID NO: 27165 - DNA, 63 bp, Anaeromyces robustus
  Thiolase-like
tccattacgtgctgcagttaactcttttggttttggtggtgctaatgctaatgctattttaga

SEQ ID NO: 27166 - DNA, 1113 bp, Anaeromyces robustus
  Thiolase-like
aattgctattattggtgttggttgtcgtttaccaggtgatattactaccaaagaagacttttggaatatgttagttactaaacgtgttgttacatcagagattccagctgatcgttgggatcgtgaagaatggtatagtaaggaaccaatcccaggtactattcaaactaaacatggtggtttcctttctaatgcttatgactttgataataaatatttttctatttctcaagctgaagcacttgaaattactccagaacaacgttggttatgtgaacttgctgttgaaaccatggaagatgctaatatacgtccagaagaattaaagggtagtcaaacaggtgtatttgttggttcagcaggtattgattttggtggtaaccaattagtaaatacattacaaatgtctgcacacactatgactggtttagaaccatcaattttttctaatcgtatttcttacatttttgatttacatggtccatccattactagtaatacggcttgttcagcttctatgtcttcattatctatggcttgtaatgctatagcagttggtgattgtgataaggcttttgttgctggttctaatttcttacctactcctggtggttatgttgctttctcacaacttagagttgtttcaaagactggttcatgtaaaccatttgatgaaaaagctgatggttatgctagacttgaaggtgcttgtatgttattgattaaagattatgaaaaggcgattagagataatgataagatttatgctacaattattggtagtggtaccaatgaagatggtcgtacattatctattacccttccttcctctgatgctcaatgtgctttaatgaaatgggtatgtgaaaagagtaatattaaggctgatactattgattatgttgaagctcatggtactggaactccaactggtgatccaattgaagccagatctattggtaatgcttttggtaaggttgttcgtactccaggaagtaaacctcttccagtaggtacagttaaaggtaatgttggtcatggtgaatttttaagtggtgctattggtttattaaagacttctttaatgcttttcaataagcagttagttccaac

SEQ ID NO: 27167 - DNA, 501 bp, Anaeromyces robustus
  Thiolase-like
tattggtattattggtttagcaacttatattccagcaacaactgttagtatgacaaaattagaagctcatgataaatgtcaaggtaaatatactattagtttaggccaaaagtatatgtcattaactgctccaaatgaagatgttgtatctatggccttaaatgctgttaaacgtttaatgaaaaaaatgaatttaaaaccaagtgatattggtagaattcaaattggtactgaaacaccagtagatttaagtaaaagtgttaaaacatttattgtagagcaattctttgaacaaggtattactgatattgaaggtgttgataatgttaatgcttgttttggttctactgctgctttatttgatactgttgcttggatgcaaagtgatttctggaatggtagatatgctattgttgttggtacagatatttctcaaggtgaagatatttatcacttccttacaggttcatcagctgttgctgttttaattggtccaaatgc

SEQ ID NO: 27168 - DNA, 684 bp, Anaeromyces robustus
  Thiolase-like
tgaaccaaatcgtggtattttcagtaatagtacttttgatttctataagccatatggttataaaaatcattatccagtggttgatggtaaatattctattgattgttatcttaattctttagttagttgttatgaagatcttaaaaagaaatctaaatctgaaacagaattccttgatcatcaatttggtgttttccataattctagtgttagtttaacaagaaaaggtttcaatactttaattgaaaaggaaatttcaaaagttcttccaaatgctgaaccacatgaaaagagacaatttatatcgaaaatttataaagaaagagttgaagcttctactttaatgactgctaatatgggttgtatgtataatgcttcagttcttaatggtattatttcattaaatgaatccttaaaaccagaagatattggtaaacgtattttagtttattcatttggttcaggttctgttggtgctctttggtcattacgtattgacggtttagctgaaaaggatgatttaaataatagattaaataatcgtaaagaaatttcagttgattcttactttaaggtaagacaattatggcttgaagatattaagaagtttggtcgttcttataagaaagatcaatttgaacttccaatacgtgatggtgattattatttatcaagtgtatctgt

SEQ ID NO: 27169 - DNA, 1146 bp, Anaeromyces robustus
  Thiolase-like
ttatgaaaaaattgctattattggtatggctcttcgtttaccaggtgcaattaataatgctaaatctttatggatgactttacttaaaggtaaaaattgtgttgtagccccagttaaaaatagagatttacatactaattatgttaataaaccaagtaatcaattacttccaaatgaacataatattccatattttggttgttatgatactaaatctaatgttgctaaaccttcacaatttgatgctgaattctttaattgtttaccagatgaagctttatcacttgatccaagacatcgttggattttagaaacaacttgggaagctttagaaaatgctggtataccaattaattctttaaaaaatacaactactggtgtttttgttggtattaatgatgatcatgaatattcagatttattagaagaaaatggtatttctattcctatttcttctcattctaatcatccaagtgatattgctggtcgtttaagttatttttataatttatatggtccatcttatactatggatacggcttgttctacaggtgcttcagctattcatgtagcttgtcgttccttacaaaatagagattgtaatttatgtatggttactggtgttaaatatatgtattcttcaaaatctttaagtaaagcttgttcagctagaatgatttcccctcatggtcgttgtgctacttttgatatagatgccgatggatttgtaccaggtgaaggttgtgttacatatattttaaaacgtttaaatgatgctattgaagataatgataatattttatctgttattattggtagtagtagtggtcaaagtggattaagacaatccattagtgcaccatcatcagaaggtcaagctcttaatattcgtaaagctatggaatttgctcaagttaaaccagaagatatttcttatgttgaagctcatggtacaggtaccccattaggagatgctatggaaattcatgctttaaatgaagtttatgctggtactcattcaaaagaaaatccattaattgttggtagtattaaaactaatattggtcatacttgtgaagttgctggattagcaggattagctaaagttattgtttcattacaacataaacatataccaagaaatct

SEQ ID NO: 27170 - DNA, 660 bp, Anaeromyces robustus
  Thiolase-like
agaattatgttctgtagcaggtcgtctttcctatttttataaattatatggacctgctatatcgattgatacagcatgttctacaggagcaacagcagtacatgttgcttgtcgttcaattcaaatgggagaatgtgatttagctattgtttcaggagctcgatatctttattataatgatgaatttattaatacatcacatgcaaaaatgacatcaccaaataatcgttgtgctacatttgatgaatcagcggatggatttgcatcttctgaaggatgtgttaccttaattcttaaaagattagatgaagcagaagaaaataatgataatatctatggagttattcttggatcaagtaatggacaaagtggaggaagacaatcaatttcagtaccatcatcagaagcacaagaacgtaatattcgaaatgcaatgaaaaatgcaaatgtatctcctaaagatatttcatatattgaagctcatggtactggtactccctatggagatgcattagaaattcatgctattaatcaaatatttggacatactcatactcaagattctcctctttatatcggtagtgtaaaaacaaatataggacatacatgtgaagcatcaggattagcaggacttgtaaaagttttattatccatgaaaca

SEQ ID NO: 27171 - DNA, 399 bp, Anaeromyces robustus
  Thiolase-like
taatcttatagctattgtaggtattggattacgtctaccaggtggtattaattcaactcaaaaattttggctttctcttattaaaggaagaaattgtttatcaaatactccaactgatcgtcaattacatcaaggttttgttgatatgcaaaaaaatccaaataaaaatttagatattaatgaacattatattggtaaatatggctattatgaatctgttcgtggtaccgcaaaacccacagattttgatgcagatttttttgaatgttctaaagatgaagctattggtatggatgttaaacaacgttggatacttgaaacaagttgggaagctttagaagatgcaggtattgatccatctattattgaaaattctaatactggtatatttgtaggtat

SEQ ID NO: 27172 - DNA, 660 bp, Piromyces finnis
  Thiolase-like
tgctgctgcttctttacctggtagaatcagtttcatgtataatttacttggtgctgcccacaccgttgatactgcttgttcttccggtttagttgctactcatgatgccgtcaaggacttaaaccttggtgaaactgatcttgctattgttaatgccgctcactgtccattcatgagctccggtttcagtcttttatctgtcgcaaagatggtctcaagaaactgtagatgtgctgcttatgatgaagctgctgatggttatgttcctggtgaaggttgtgtcactatcattttaaagagaaaagatgatgctattcgtgatcacaacaaaatttatggtttaattaatgctgctgctgttggtcaaagtggttctagagcttctatgagttctccaactgttattggtcaaaccaatattcataaacaagttttaaaaaaggctggtgttaatccaagtgacattgactatatggaaggtcacggtacaggtacaaaattaggtgatcgtattgaagcagaagctatcaacaatgtctttaagggtagtcactctaaggaacgtccattagttttagctagtgttaaaactaacattggtcatactgaagaagttagtggtttagcttctcttgttaaagtattattagctatgaaaaa

SEQ ID NO: 27173 - DNA, 393 bp, Piromyces finnis
  Thiolase-like
aaatcaagttcaaattgctgttgttggtattgcgttaagacttccaggaggtataaatactgttgacaaatactggaatagcttagttgatggtagattctgtatctcaccaattggtacaaatcgtcaccttcaccactacatgtctaaagaagaaaacttaaagccaggagaacattatatttacaactatggtcgttatgattctaccccagatgctgccccaatttctgactttgatccaatgttcttcaacatgaacccaaatgaagcctctgctcttgatccaaagttccgttgggttttagaaactacttatgaagccttccaagatgcaggtattgatccagatgtcctttctggaactaatactagtgtatacactgctccagg

SEQ ID NO: 27174 - DNA, 1125 bp, Piromyces finnis
  Thiolase-like
ctccaacaaaattgcaattattggtatggcacttcgtttacctggtgctatcaataactcaaaatctttatggatggctttagcaaagggtaaagattgtgtattacctccagttaaaactagagatttacacactcgctatgctaataaatcagctgatcaattagaattagatgaacattatcttccacgtattggttgttatgatactcgtaatagtgttgcaaaaccatctgaatttgatgcttcatttttcaattgtttaccagatgaagcagttgccttagatccaagacatcgttggattttagaaactagttgggaagctttagaaaatgctggaattgcaccaaattcattaaaaaagactacaacaggtgttttcattggtattaacaatgagcatgagcatgaagatttattacatgattgtggtattatccccccattagcttcacatgctactgcacaaagtagtattgctggtcgtttaagttacttttatcaattatttggaccttcatatactattgatactgcatgttctaccggtagttctgcactccattctgcctgccagtcattacaatgtaatgattgtaatttatcaattgtaactggtgtaaaatatatgtattcttctaaggaattccataaaacatgctcagctcgtatgacatcaccaaatggtcgttgtgctacctttgatgctagcgctgatggatttgcccaaagtgaaggttgtgtcacatttatattaaagcgttttgatgatgctgttcgtgataatgataatatcttagctgttgttcttggttccgctagtggtcaaagtggtttaagacaatctattagtgctccttcttctgaaggtcagactgttagcattaagagagctatggaaaaagccggtattacaccagaacaagttagtttcgttgaagctcacggtactggtacaccattaggtgatgcacttgaagtccatgctcttaatcaagtttatggtggcagtcacactgaagaaaatccattaattgttggtagtattaagtccaatattggacacacatgtgaagctgctggtctagccagtattgctaaggttatcgttgctatgaagta

SEQ ID NO: 27175 - DNA, 837 bp, Piromyces finnis
  Thiolase-like
agaaacaagttgggaagccttagaaaacgcaaatattgctcctaattctttagaaaactcatctactggtgttttcgtcggaattaacgatgatcatgaatactcggatttaatgactgaatgtggtattgaaacatcaatcgctagtcatggttcaagtccaagtggtatcgctggtcgtttaagttatttctatcgtttatacggcccttctttcacaattgatactgcttgctcaacaggtgctaccgcacttcacactgcttgccgttcattacaacatcatgattgtaacttatctatcgtttctggtgtcaaatatatgtattcttcaaagaacttttataaaacatgtgctgccagaatgacttcaccacatggtcgttgtgctactttcgacaaagatgctgacggtttcgttcctagcgaaggttgcgtcacttttattttaaagcgtttagacgatgctatccgtgataacgataacattctttctgtcattttaagtacgagcagtggtcaaagtggcctaagacaatctattagcgctccttcctccgaaggtcaggctatcaacatgcgtaaagctatggaatttgctggtattaaacccgaagacgtttcttatattgaggctcatggtactggtactccattaggtgatgctttagaagtacatgctttgaacgaaatttatgctggaagtcatacagaagaaaatcctctcgttgttggtagtattaaaacaaatattggtcatacttgcgaaactgctggtttagctggcatcgctaaagtcattgtttctatgcaacacaaatatattccaaagaatct

SEQ ID NO: 27176 - DNA, 316 bp, Piromyces finnis; identical to SEQ ID NO: 25634
  Thiolase-like

SEQ ID NO: 27177 - DNA, 501 bp, Piromyces finnis
  Thiolase-like
cgttggtatcattggattagctacctacattccaagtagtactgttaatatgaccaaattagaagcgcatgataattgtcaaggtaaatatactattagtttaggacaaaagtacatgtcattaactgcaccaaatgaagatgttgtatccatggctttaaatgctgttaaacgtttaatgaagaagatgaacttaaagccaagtgatattggtagaattcaaattggtactgaaacaccagttgatttaagtaagagtgtcaagacctttattgttgaacaattctttgaacaaggaattactgacattgaaggtgttgataatgttaatgcttgcttcggttctactgctgccttattcgatactgtagcttggatgcaaagtgacttctggaatggtagatatgctattgttgtaggtactgatatttctcaaggtgaggatatttatcacttccttactggttcatcagccgttgcattattaattggtccaaacgc

SEQ ID NO: 27178 - DNA, 684 bp, Piromyces finnis
  Thiolase-like
tgagccagaacgtggtattttcagtaatagtacttttgacttttataagccatatggttacaaaaaccattacccagtagttgatggtaaatactctatagattgttacctttcttccttaaagagttgttatgaacaacttaagaagaagactggttctgaaaccgaattccttgatcatcaatttagtgttttccataattcaagtgttagtttaactagaaagggtttcaatactttaattgaacaagaaatttccaaagtacttccaaatgccaagataattgaaaagagaaaattcatttcaaatgtttacaaagaaagagttgaagcctctactttaatgacagctaatatgggttgtatgtacaatgcttctgttcttaatggtattatttccttaaatgaatctttaaccccagaagatattggcaaacgtgttttggtttactctttcggttcaggatctgttggtgctctttggactttacgtattgatggcttagctgaaaaggatgatttagttaatagattgaatagtcgtaatgaagtttcagtagatacatactttgaaattagaaaattatggcttgaagagattaaaaagtttggacgttcatacaagaaggatcaatttgaacttcaaatccgtgaaggtgattattatttatcaagtgtttccct

SEQ ID NO: 27179 - DNA, 1113 bp, Piromyces finnis
  Thiolase-like
aatcgctattattggtgttggctgtcgtttaccaggtgatatatcaacaaaagaagacttttggaacatgttagttaccaaacgtgttgttacttcagaaattccatcagatcgttgggaccgtgaggaatggttcagtgaagatcctgttccaggtaccatacaaactaagtgtggtggtttcattaccaatgcttatgattttgataacaaatatttctctatttctcaagctgaagcttttgaaattactccagaacaacgttggttatgtgaacttgccgttgaaactatggaagatgctaatattcgcccagaagaattaaaaggaagtcaaactggtgtctttgttggttcagcaggtattgattttggtggtacacaattagctaatactcttcaaatgtctgctcatactatgactggtttagaaccatccattttctctaatcgtatttcttacatttttgatttacatggtccatcaattactagtaatactgcttgttctgcctctatgtcatctttatctatggcttgtaatgctattgctgttggtgattgtgacaaggcttttgttgctggttcaaactttttaccaactccaggtggttttgttgccttctctcaacttagagtcgtttctaaaaccggttcttgtaagccatttgatgaaaaggctgatggttatgctagacttgaaggtgcttgtatgcttttaattaaggattatgaaaaggctgttagagataatgataagatttatgccactattattagtagtggtactaatgaagatggtcgtactttatctattactctgccatcttcagatgcccaatgtgccttaatgcaatgggtttgtgaaaagagtaatatcaaggctgataccattgattacgttgaagcccatggcactggtactccaactggtgatccaattgaagctagatctatcggtaatgcatttggtaaaaaggttcgttctccaaatagtaaaccacttccagttggtactgttaaaggtaatgttggtcatggtgaattcttaagtggcgctattggtttattaaaggtttctttaatgcttttcaacagacaattggttccaac

SEQ ID NO: 27180 - DNA, 354 bp, Piromyces finnis
  Thiolase-like
tggtacaccattaggtgatgctattgagactgaaacattaaataaagcttttggtggtagtcatactgaaaagaaaccattagttgttggtagtgtcaaaacaaatattggtcacaccgaagaagtatcaggtttagccggtttaactaaggttattttatccatgtctcaccgtattattccaccacatcttcatttaaatactttaaatccaaaaattgatctttctgttattccaatgtctattccacaaaagaagagtatttggaagtgtccacgtggtaaaaagagaattggtcttgtttcttcctttggtttacaaggtagtgttgctaatgctgttattgaagaatt

SEQ ID NO: 27181 - DNA, 354 bp, Piromyces finnis; identical to SEQ ID NO: 27180
  Thiolase-like

SEQ ID NO: 27182 - DNA, 718 bp, Piromyces finnis
  Thiolase-like
ggtaccaattgccgttattggtatgggtattcgtttaccaggtggtattaatactccaaccaagtattggaatgctttagtaaatggaaaagattgtatatcaccaactccaaataatcgtcatcttcaccatttcttaagaccaaactgtccacataacgaattaggtccatatgatcattatgttcatcgtgctggttattatgatgttgttccagatgctgcaccaattactgattttgatccaactttctttaacatttctccattagaagcaaaatttactgaaccaaagtttcgttgggtctatgaaactgtttatgaagctttccaagatgcttgtatcgatatttctgagttaaatggttctcgcactggtatttattgtactgttggtggtacatttgattacattggtttaactaaggctttcgttagtggtcaaactatgacaagtcaaactatgcatggttctgctgcttctagttgtgctggtcgtatagcatttaattatggtttcattggtccatctgataccgttgatactgcttgttccagtggtttaaatgatgtcaataatgcttgtaagtctctttcttgtggtgacactgatattgctgtagcatctgctgttcaccatcaatatgttagtactcaattccatgttatctctgttgctcacatggcttctcaaactggtcgttgtgctacctttgat

SEQ ID NO: 27183 - DNA, 280 bp, Piromyces finnis; identical to SEQ ID NO: 26334
  Thiolase-like

SEQ ID NO: 27184 - DNA, 249 bp, Piromyces finnis
  Thiolase-like
tgttggtcatggtgaatacttaagtggaattattggtttaattaagagtaccttaattcttcataaaaatatgattgttccacaaacagcatttgatacccttaatccaaagattgaatgtgaaaaattaggtattcgtattgctaataagatagaaaaatttccaggtcaaggacgtcatagagttgctgttaactctttcggttttggtggtgctaatgcaaatgctattatagaagaggaacccca

SEQ ID NO: 27185 - DNA, 1038 bp, Piromyces finnis
  Thiolase-like
tgctattattggtacaggtattcgtttaccaggtgatattaataataaggatgatttctggaaggtaatgatagagaaaaaagtaattactggtcttactccagaagatcgttgggatcgtgatgaatggtattgtaagacagaaaagcccggaacaattcaaactttatatggtggttttatcgagaatgcttttgattttgataataaattcttttctatttcccaaaaagaagcattagatgctactccggaacaaagatggctttgtgaattaactgttgaaaccattgaagatgccaatattaatattgataaatttaaaggaagtaatactggtgtttttgttggtacttcaggtatagattatggtagttacgttttttcagtaccagaaaaaattacaaaatatacttatagtggaattgaaccttctattcatgccaatcgtgtttcttatcttttcgatcttcacggtccatcattatccaccaataccgcttgctcttcttcattgactgctttatccattgcttgtaattctatggccgctggtgattgtgaaatggctattgtcgctggtactaatttcttccaagctccagcaaatggtgttgcctattctcaacttcgtgttgtatcaaagaaaggcgcttgtcgtccattcgatagtggtgctgatggttatgctcgtttagaaggtgctggtatggttttattaaaaccttatgaaaaggccatccgagataataataaaatttatgctactattttaagtactgcttgtaatgaagatggaaaaactgcttctttaactactccatcttccaaagcccaatataaattaatgaagcgtgtttatgaaaagggtcatattgatccatgtactattgattttattgaagctcatggtactggtactgctgttggtgatccaattgaggctagttccattggtgaagcttatggtaaaattaataaagccaatggaaatccagccatcccagtcggatccgttaaaggtaatgttggtcatgg

SEQ ID NO: 27186 - DNA, 180 bp, Piromyces finnis
  Thiolase-like
tgttgttgtcactggttatggtgaagtaggtccatatggtaactctcgtactcgttgggaaatggaagcctatggtaaattctctcttgaaggatgcattgaaatggcttggattatgggtatgattaaatatgctaagaacaagaagactaaggatggtaaactctattccggatgggt

SEQ ID NO: 27187 - DNA, 639 bp, Piromyces finnis
  Thiolase-like
aattccaactggttggaagccagaaacttatggtgttccaaagagtattattgaccaagttgatccaataaccctttatgttattgtagctactgttgaagctttaattagttccggtattactgatccatatgaattctatgaatatgtacatgtctctgaagtcggaaactgttctggtggtggtgttggtggtatgacctctaatcataagcaatactttgatcgtgtatttgaaaaaccagttcaaagtgatattcttcaagaatgtttcattaacactatgccagcttggattaacttattattactttcttcttctggtccaattaagactccagttggtgcttgtgctactgctgtcgaatctgttgaaattggtttagaaaccattttaagtggtaaggctaaaattgttattgttggtggttatgatgacttccaagaagaaggttcatacgaattcgctcaaatgaaggctacaagtaattccttggaagaacttgctcatggtcgtgatccatcagaaatgtctcgtccagctactactacaagagctggtttcatggaagctcaaggtgctggtcatgaaattttaatgactgctagtcttgctattaagatgggtgttccaatcta

SEQ ID NO: 27188 - DNA, 411 bp, Piromyces finnis
  Thiolase-like
aagaggtgctcttgctgtctttggtttaactattgatgatattcaagccttatccttccatggtactagtactaaggctaacgattctaatgaatctgaagtattcaacaagcaattcaagcaccttggacgtactaagggtaatgcttgcccagttattactcaaaagtacttaactggtcatccaaagggtgctgctgcttcttggatgcttaatggtatgcttcaagttattgaaactggtattattccaggtaatcgtaatgctgataatattgatgaaaagcttcgtaagttcgaatacctcttctacccatctcgttctattcacactgatggtgtcaaggctggtttattgaagtccttcggttttggtcaagttggtggtgaagttttagttatttccccaga

SEQ ID NO: 27189 - DNA, 207 bp, Piromyces finnis
  Thiolase-like
tccatcagaaatgtctcgtccagctactactacaagagctggtttcatggaagctcaaggtgctggtcatgaaattttaatgactgctagtcttgctattaagatgggtgttccaatctatggtattattgctcatacctctactgctactgataaggaaggacgttctgttccagctccaggtcaaggtattttaaccactgctcg

SEQ ID NO: 27190 - DNA, 411 bp, Piromyces finnis
  Thiolase-like
acgtggtgctttagctgcctttggtcttactgttgatgatattggtgttgcttccttccacggtactggtactaaggccaatgataagaatgaatctgatgtattcaacaagcaattcgaacatcttggtcgtactaagggtaacgcttgtccagtagtttgtcaaaagtatcttactggtcacggtaagggtgctgctgctgcttggatgttaaatggtgttatccaaattcttcaaactggtattgttccaggtaaccgtaatgctgataacattgatccacttcttgaaaagtatgaacatctttggttcaataacaagactttcaagactccaggtgttaaggctggtttattaaagtcattcggtttcggtcaagttggtggtgaaattttagttgtccacccaga

SEQ ID NO: 27191 - DNA, 207 bp, Piromyces finnis
  Thiolase-like
tccatcagaaatgtctcgtccagctactactacaagagctggtttcatggaagctcaaggtgctggtcatgaaattttaatgactgctagtcttgctattaagatgggtgttccaatctatggtattattgctcatacctctactgctactgataaggaaggacgttctgttccagctccaggtcaaggtattttaactactgctcg

SEQ ID NO: 27192 - DNA, 180 bp, Piromyces finnis; identical to SEQ ID NO: 27186
  Thiolase-like

SEQ ID NO: 27193 - DNA, 639 bp, Piromyces finnis; identical to SEQ ID NO: 27187
  Thiolase-like

SEQ ID NO: 27194 - DNA, 180 bp, Piromyces finnis; identical to SEQ ID NO: 27186
  Thiolase-like

SEQ ID NO: 27195 - DNA, 639 bp, Piromyces finnis; identical to SEQ ID NO: 27187
  Thiolase-like

SEQ ID NO: 27196 - DNA, 411 bp, Piromyces finnis; identical to SEQ ID NO: 27188
  Thiolase-like

SEQ ID NO: 27197 - DNA, 207 bp, Piromyces finnis; identical to SEQ ID NO: 27191
  Thiolase-like

SEQ ID NO: 27198 - DNA, 411 bp, Piromyces finnis; identical to SEQ ID NO: 27190
  Thiolase-like

SEQ ID NO: 27199 - DNA, 207 bp, Piromyces finnis; identical to SEQ ID NO: 27189
  Thiolase-like

SEQ ID NO: 27200 - DNA, 180 bp, Piromyces finnis; identical to SEQ ID NO: 27186
  Thiolase-like

SEQ ID NO: 27201 - DNA, 639 bp, Piromyces finnis; identical to SEQ ID NO: 27187
  Thiolase-like

SEQ ID NO: 27202 - DNA, 1122 bp, Piromyces finnis
  Thiolase-like
aaaatttgctgtcattggtattggttgtcatttcccagaaggtattgaatcaaaggaatccttctggaaaatgttggaagatggtaaatgcattaccaaagatattccaaaggaaagatgggataaagatgaatggtattctaaagaacctgttcaaggaaccattcaaaccaaacgtggtgccttcttagagaatccatatcttttcgataacaaatatttttacatctccatgccagaagctaaggaaatgtcaccagaacaacgctggctcttagagttaaccgttgaaactcttgaagatgcaaatatcaaaccagaaactttaaagggttctcgtactggtgtttttattggatcatcaggtattgattacttagttacccaaatttctcatgctaatgatattaattcacacagtcctactggttttgagctttccattttagccaatcgtttgtcttatgtctttgatttccaaggaccatctataagttgtaatactgcatgttcatcagcattctctgctttaaacatcggtttaaatgctatgattactgatgattgtgaaatggctattgttgctggttcaaactttatgagttgcccaggtagttttgtagcttattctcaacttcgtgttgtttctaaagatggttcatgtaaaccatttgatgaaaaagctgatggttatgcaaagttagaaggtgctggtatgatattagttaaaccttatgagaaagctgttcgtgatggtgataagatttattgtgcaattgttggttgtggtagtaatgaagacggtcgttccccatctcttactatgccttcctatgaagcacaatataagttattaactcatgtttgtgagaaatctggtattaatccaactcaaattgattatgttgaagcccatggtactggtacaaaggttggtgatccaattgaatcccatgctataggtgatgcttatggtagaggtaagggtattcgtggtccaaatgacccacctgtattagttagttctgtaaagggtaatacaggtcatggtgaaaattctagtggtattgtaagcattattaagacttcaatgatgctttataaacgtaaattagtaccaac

SEQ ID NO: 27203 - DNA, 960 bp, Piromyces finnis
  Thiolase-like
atatgctgtcattggtgttggttgtcgtttcccaggtaatattaaatcaaaggaagatttctgggaaatgcttactactggaagatgtcttacctctgaaactccaaaggaccgttgggattctgctgaatggtataacaaagagccaaagagaggtactgttcaaactactagaggtgcatttatggaagatgccttctactttgataataagtatttctcaatttctcaaaatgaagctaaggaaatgtcaccagaacaacgctggttattagaattagctgttgaaacctttgaagatgctaacattaatccaaagaaattaaagggttctagaactggtgtctttgtcggttcttccggtatggatttcgtagcagctcaaatttctcatgctaatgatttaactcaacactctgctactggtcttgaactttctattcttgccaaccgtatctcatactactttgatttaaatggtccatctatttgtactaacactgcatgctctgcttctatgactgccttaaatcttgctattaattccatgattactgatgattgtgatgcagctcttattgctggtactaatttattattcactccaggtagttgtgttgcatactctcaacttcgtgttgtctctgttgatggttcttgcaaaccatttgataagagggctgatggttattctcgtgttgaaggtgctggtatgttattgattaagccatatgaaaaggctgtaagagatggtgataaaatttattgtgctattttaggtagtagtactaatgaagatggtcataccccatctctcactatgccatcctatgattctcaatgtaaattattaactcatgtttgtgaaaaattcgacattgatccagcctcaattgattatgttgaagctcacggtactggtactgcagttggtgatccaattgaagctcgttcaatagg

SEQ ID NO: 27204 - DNA, 114 bp, Piromyces finnis
  Thiolase-like
tccattgatcattggatctagtaagggtaatactggtcatggtgaatattctagtggtattattggtatgattaaggctgttttaatgcttcaccatcgtactatggttccaac

SEQ ID NO: 27205 - DNA, 60 bp, Piromyces finnis
  Thiolase-like
tttacgtattgctgttaactcttttggttttggtggttcaaatggtaatgccatttttga

SEQ ID NO: 27206 - DNA, 1149 bp, Piromyces finnis
  Thiolase-like
caaatcaaatagtattgctattattggtatgggtttacgtcttccaggtgctatcaatagtgacaagtctttatggtctactttagttaaaggcagagactgtattacagctattccaaaggatagaaaattacatgaaaactatgttgataagcaaagtagtgaattaaacatgggtgaacataatgttaagcgttgtggctactatgactcccgttcaagtggtaaaaagatttctcaattcgatgcagaatttttcaattgccttccggatgaagctattggtcttgatccaaagcatcgttggatcttagaaacaagttgggaagctcttgaaaatgctggtatttcacctgaatcccttgaaaataccgatacaggtgtttttgttggtattggtgatcaacaagaacatgtcaagtttatgcaagaatgtcaaaaggaaaaagttgttgcccatcacaatagtaatccatcagctattgctggacgtttaagttacttttacaaactttatggtccatctgttactgttgatacagcttgttccactggtgcaacagctcttcatactgcctgtcgttctatgattttcggtgattgtaacctttccattgtgaccgcctccaaattcttattctattcagaagaatttgaaatgacaagtaaggcaagaatgacttctccatctggtcgttgtgctacttttgataagaatgctgatggttatgtcccagctgaaggttgtgtaacctttatattaaaacgtttagaagatgctgaacgtgataaggatcatattcttggtgtaattcttggtactagtagtggtcaaagtggtttccgtcaatccattagtgttccttcatcagaaggtcaagctcgtaatattgaacgtgctatggcagttgctggtgttcaaccttctgacatatcttacattgaagcacatggtactggtacaccatatggggatgccattgaaattcaaggtattaatcaagtttatgctggaagccacacctcggaacatccattagtcatcggtagtatcaagacaaatattggacatacagctgaaactgctggtttagctagcattgccaaggttttattagctatgaagaataaaactattccaagaaatct

SEQ ID NO: 27207 - DNA, 816 bp, Neocallimastix californiae
  Thiolase-like_subgr
agttgctgttgttggtattgctttaagacttccaggtggtatcaataccgttgataagtattggaagagtttagaaaatggtagattttgtgtctctccaacaggtactaaccgtcatcttcaccataacatgactcacaatgaggaactaaaaccaggagaacattacattttcaactactgtcgttatgatagtactccagatgcagctcctatcactgattttgatccaatgttctttaatatgaatccaaatgaagccactgttcttgatccaaagttccgttgggtcttagaaactacttatgaagttttacaagatgctggtattaacccagattctctctctggtactcatactaatatttacactgcccctggacaagttgatgaaatgaatgcttatgctactaatgcctctccaactggttacagtgttcttaatggtatgagtatgcatagttgtgcttctgcttccttaccaggtagaattagtttcatgtataatttatttggtgctgctcacaccgtagatactgcctgttcttccggtttagttgctatccatgatgcttttaaggatttgaatattggtgaaactgatcttgccattgtgaatgctgctcactgtccattccaaagttcttctttcagtcttttatcaatagcaaaaatggtttccagaaactgtagatgtgcttcttacgatgaagcagcagatggttacgttccaggggaaggttgtgtttccgttattttaaagagaaaggatgatgccattcgtgatcataataagatttatggtttaattaatgc

SEQ ID NO: 27208 - DNA, 495 bp, Neocallimastix californiae
  Thiolase-like_subgr
tgctgtcggtcaaagtggttccagagcttctatgagtactccaacggttctcggtcaaaagtacattcataaaaaggtccttgaaaaggctaatcttactccaggagatattgattatatggaaggtcatggtactggtaccaaattgggtgatcgtattgaagctgaagctattaatgaagttttcaagggtactcactctgagagccgtccattaaccttagctagtgtaaagactaacattggtcacactgaagaagttagtggtttagcttctttggttaaggttttattagcaatgaagcataagaccgttcctcctcatcttcacttcaataagccaagtcctttgattgattttgattccgttccattacacattccaactcaaaaggaagaatggaagccagctgaaggaaagaaacgtgttgctttagtttcttcctacggtctttcaggtagtgtctgtgatgctatcgtagaggaatacattga

SEQ ID NO: 27209 - DNA, 495 bp, Neocallimastix californiae
  Thiolase-like_subgr
tactacttcacaatctggtattagaccatctatttcttctccagcggttggtccacaagttgagaatattcaaaaagctttacaaattgctaatgtttctccagctgatgttgattatgttgaagctcatggtactggtacccaagttggtgatgctattgaaactgaaactttaaacatagcctttggtggtactcacaatgctaagaagccattaattgtaggtagtgtaaagactaacataggtcacactgaagaagtttctggtttagctggtttatgtaaggttcttttatctatgtctcatcgtactattccaccacatcttcacttaaagaatttaaatccacgtattgatacctccgttattccaatgaccattccacaaaagaaatgtatttggaagagtccacgtggaaagaagagagttggtgttgtttcttcttttggtttacaaggtagtgttgctaatgctgtaattgaagaatttaaact

SEQ ID NO: 27210 - DNA, 825 bp, Neocallimastix californiae
  Thiolase-like_subgr
tccaattgctgttgttggtatgggtcttcgtttaccaggtggtattaatactccttctaaatattggaatgctttagttaatggtaaggattgtatttcaccaactcctgctaaccgtcatcttcaccaatatttaaggccattttgcccaccaaatgaattaggcccatttgatcactatattcatcgtgctggttattatgatgttactccagatgctgccccaatttctgattttgatccaactttctttaatatttctccattagaagctaaattcactgaaccaaaattccgttggatctatgaaactgtttatgaagctttccaagatgcttgtataaatgtttctgaattaaatggaactcgtacttctgtttttactactgttggttctactgctgattatattgctttaactaaggcttttactaaagttgaatcaatgactagtcaaactatgcatggttctgctgcttctagttgtgctggtcgtatttccttcaactatggttttattggtccatctgatactattgatactgcttgttctagtggtttaaatgattgtcacaatgcttgtaaatcactttctatgggtgattctgatgtagctgttgtttctgctgttcaccaacaatttgtatctactcaattccatgttatttctgttgctcatatggcttcacaaattggtcgttgtgctacttttgatgctgaagctgatggttatgctcctggtgaaggttgtattagtattattcttaaacgtttagatgatgctgtaactgatcatgatcatatttatggtgttattactggtat

SEQ ID NO: 27211 - DNA, 780 bp, Neocallimastix californiae
  Thiolase-like_subgr
tgctattattggtattggttgtcatttcccagaaggtatagagtcaaaggaagctttctggaaaatgttagaagatgctcgttgtatcacaaaggatatacccaaggatcgatgggataaaaatgaatggtattctaaggaacctattcaaggtacaattcaaactaaacgtggagccttcctaaaaaacccatatcttttcgataataagtatttctatatctctatgccggaagctaaagaaatgtcaccggaacaacgttggcttttagagttaactgtagaaaccttagaagatgcaaacattaaacctgaagctgtccgaggatcacgtacgggtgtcttcattggatcttctggttgtgattatttagccactcaaatttctcatgccaatgatattaattctcattctcctactggatttgaactttctattttagctaaccgtttatcctatgtttttgatttacaaggaccctccattagttgtaataccgcttgttcttctgcattttctgctttaaatatcggtttaaatgctatgattacggatgattgtgaaatggctctcgttgctggttctaattttatgaattgtccaggtggatttgtggccttctctcaacttcgtgtcgtttctcctgacggttcctgtaaaccttttgatgaaaaggctaacggttatgccagattagaaggagctggtatggtattaattaaaccctatgaaaaggccgttcgtgatggtgataaaatttattgtgctatcgttggttg

SEQ ID NO: 27212 - DNA, 504 bp, Neocallimastix californiae
  Thiolase-like_subgr
tggtagtaatgaggatggtcgttctccctccctgactatgccatcctatgaagcccaatataagcttttaagtcatgtttgtgaaaaatcaggcatacttccatcagaaattgattatgtggaggcccatggtactggtactaaagtaggagatccaattgaatcccatgccattggagatgcctatggtcgtagtaaaggggttcgtggaccaaatgatccccccgtcctcgtaagttcagtcaagggtaacacaggccatggtgaaaattcgagtggtattgttagtatcataaagacctcattgatgctccataaacgtaaattagtacccaccgttgcttatcatcatatgaaccctgccattgatgctgaaaaattaggaattaaggtatgtgaaactttagaggattggaaaacgcctcatacccttcatgctgctgtcaattcttttggttttgggggtgccaatacaaatacgattttggaagaggtaaaacatct

SEQ ID NO: 27213 - DNA, 792 bp, Neocallimastix californiae
  Thiolase-like_subgr
ggcttttcgtttacctggagctattagtaattctaaatcattatggatggctttagctaaaagtagggattgcatcttacctccagtgaaaactagagatttacatcatggctatgtgaataagccagccaatcaattaggccccaaggaacactaccttgctcgtgtgggttgttacgatgttcgtcctaacgtggctaaaccttcagaattcgatgcagacttctttaactgttcaccggaagaagctactgctcttgatccaagacatcgttggatcttagaaacgagttgggaagctttagaaaatgctggtattgtaccaagctcgcttaaaaataccatcactggagtctttgtcggtatgaacaatgatcatgaacatgaagatctattaaagaaatgtggtaaagttccaccgttagccgctcatgccaccgctcaaagtagtattgccggtcgtctcagctatttctatgaactctttggtccttcctacaccatcgataccgcctgttctacaggttcctctgcccttcattctgcttgtcagtctatgcaatgtggggactgtgatctttctatcgtttctggcgtaaagtatatgtattccagtgatgaattccataagacttgtgcggctcgtatgacttcgccgaatagtcgttgtgctacctttgacgccagtgccgatggtttcgctcaaagtgaaggttgtgtgacctttgttttaaaacgtcttgaggatgccattcgtgataaggataacatcttatcggttatcctgggttc

SEQ ID NO: 27214 - DNA, 498 bp, Neocallimastix californiae
  Thiolase-like_subgr
cagtagtggtcaaagtggtttaagacaatccattagtgctccttcctcggaaggtcaaagaattacgattcagagagccatgaaggtcgccggtatcactccagatcaagtctcctatgtagaggctcatggtacgggtacccccttaggggatgccatcgaggttcatgcgctcaatcaagtctacgccggtagtcacacggaagaaaatccattagttgttggtagtattaaatctaatattggtcatacctgtgaagctgctggtttagcaggtatcgctaaggttattgtggccatgaagcataatactattccaaagaatattcatttcaatgaacttaatccggagattgacctcagcgtgattccaatgaaaattccaaccaagaatttaccatggaattcttctgaggaaggaaaacctttaattgctcaagtatcctcctttggattacaaggtagtatcattgttaccttccttgaacaatatcttcc

SEQ ID NO: 27215 - DNA, 777 bp, Neocallimastix californiae
  Thiolase-like_subgr
tgttattggtgttggttgtcgtttcccaggtaatattaaatctaaggaagatttctgggaaatgcttacttcaggtcgttgtcttacttcagaaataccaaatgatcgatggaatactgcggaatggtataacaaggaaccaaagagaggtactatgcaaaccacaagaggtgcttttatggaagatgcattctattttgataataaatacttctctatttctcaaaatgaagctaaagaaatgtctcctgaacaacgttggttaatggaattagcagttgaaacctttgaagatgctaacatcaatccaaagaaattaaagggttcaagaactggtgtatttgtcggctcttctggtatggactttgtttcagcccaaatttctcatgctaatgatttaactcaacattccgctactggtctagaactctcaattcttgctaatcgtatttcttacttctttgatttgaatggtccatccatttgtactaatactgcttgctcagcttcaatgaccgccttaaatcttgctattaattcaatgattactgatgattgcgatgctgcactcgttgctggaactaatttattatttactccaggtagttatgttgcttattctcaacttcgtgttgtttccactgatggttcatgtaagccattcgataagaatgctgatggttattcacgtattgaaggtgctggtatgattttaattaagccatatgaaaaagctgttaaggatggtgataagatttactgtgctattttaggtag

SEQ ID NO: 27216 - DNA, 549 bp, Neocallimastix californiae
  Thiolase-like_subgr
tggtactaatgaagatggtcatactccatcattaactatgccatcttacagttctcaatgcaagttattaacacatgtttgcgaaaaatttgatattgatccagcttcaattgattatgttgaagctcatggtacaggtactgcagttggtgatccaattgaagctcgttccattggttacgcctatggtcgtagagttcgtgaaggaaagcaaattaaaactactcgtccaggtgaaactgaagaaattttagatcaacctactttcccattacttattggttcaagtaagggtaatactggtcatggtgaatattcaagtggtattattgggatgattaaggctatcttaatgttataccaccgtactatggtgccaaccattgctcataaggaaatgaacccagcaattgatgctgaaggtttaggaattaaggtagctactaaattggaaccatggaccactccacatactttacgtattgctgttaattcttttggttttggtggttccaatggtaatgctattttcgaagaagttgttaatga

SEQ ID NO: 27217 - DNA, 678 bp, Neocallimastix californiae
  Thiolase-like_subgr
atttgaccgtttagtttctggtcaattaccaaccggttgggatccagctcgttacggtattccaaaagatatcattgaacaagttgatatcattacctgctactgtattgtctctgctgttgaagccttagttagtgctggtattactgatccatacgaattctacgaatacgtccacgtttctgaagttggaaatgcctgtggttctggtgttggtgctgaacttgccaaccgtgctatcttcaaggaccgtttccttgacaagccacttcaaagtgatattcttcaagaaaccttcgttaataccatgagtgcctggattaacttattattactttcttcctctggtccaattcgtaccccagttggtgcctgtgcctctgccgttgaatctgttgatatcggtattgatactattttatctggtaaggctaaggttgtctttgtcggtggttatgatgacttccaagaagaaggttcctatgaattcgctcaaatgaaggctacctctaactctcgtgaagaaatggctcaaggtcgtgaaccaaatgaaatgtctagaccaactgcctcctctcgtggtggtttcatggaagctcaaggtgttggtacacaagttttaatgccagctagccttgctcttaagatgggtgttccaatctacggtattgttgctca

SEQ ID NO: 27218 - DNA, 492 bp, Neocallimastix californiae
  Thiolase-like_subgr
tcaaagtggtttcagacaatccattagtgctccttcctatgaaggacaagctattaatattgaaagggcaatgaaaattgctggaatcaagccagaacaagtttcttacgttgaagctcacggtacaggtaccccattaggtgatgctattgaaattcatgctcttaataaagtttatggtggtagtcatacggaagaaaatcctttaattgtcggaagtattaaatcaaacattggccatacctgtgaagctgctggtttagccggtattgcaaaggtcatcgtttccatgaaacataatcttattccaaagaatattcatttcaataaacttaacccagaaattgatatttcagctattccaatgaagataccaacaaaacatataccatggacttctcctaacgaggatgaaccacttattgctcaagtttcttcctttggtttacagggtagtattatagtcaccttccttcaacaatatatccctaa

SEQ ID NO: 27219 - DNA, 795 bp, Neocallimastix californiae
  Thiolase-like_subgr
tggtatggcattacgtttaccaggtactatcaataattctaaatcattatggatgtcattagccaaaggaagagattgtgttttgccaccagttaaaactagagatttacatcatggttatgtcaacaaatcatttaatgagttaggtccagatgaacactatcttcctcgaattggatgttatgatactcgtagtaatgctgctaaaccttcagaattcgatgcctcgttctttaactgtactgctgaagaagctatctcattagatcctagacatcgttggatcttagaaacaagttgggaggcattagaaaatgcaggtattgctccaaattctttagaaaatactttaaccggtgtctatgtcggtattaataatgaacatgaacatgaagatctattaaaggaatgtggtatcgttccacctgttgcttcccataccttaaatcaaagtagtattgcgggacgtttaagctatttctataaactttttggtccatctttcactatcgatacggcctgctctactggttcttctgcacttcatactgcttgtagagctatgcaatatggtgaatgtgatctatctattgttactggtgtaaaatacatgtattcctccaaggaattccataaaacatgttctgcccatatgacttctccaaacggtcgttgtgctacgtttgatgaaagtgcagatggatttgctcagagtgaaggttgtgttacttttattttaaaacgtcttgatgatgctattcgtgataacgacaatattttaactgttattcttag

SEQ ID NO: 27220 - DNA, 783 bp, Neocallimastix californiae
  Thiolase-like_subgr
aatagctattattggtgttggttgtcgtttaccaggtgatattttaaccaaagatgatttttggaatatgttagtaacaaaacgtgttgtcacaactgaaattccagctgatcgttgggatcgtgatgaatggtatagtgatgagcctattccaggtactattcagacgaaacatggtggtttccttactaatgcttatgattttgataataaatatttttctatttctcaagctgaagctcttgaaattactccagaacaacgttggttatgtgaacttgctgttgaaactatggaagatgctaatattcgcccagaagaattaaaaggtagtcaaacaggtgtttttgttggttctgctggtattgattttggtggtaaccaattagttaatacattacaaatgtccgctcataccatgacaggtttagaaccatctatcttttctaatcgtatttcttacattttcgatttacatggtccttccattacaagtaatactgcatgctctgcttcaatgtcctctttatctatggcttgcaatgctattgctgttggtgattgtgataaggcttttgttgctggttccaatttcttaccatctccaggtggctatgttgctttctctcaacttagagtagtttctaagactggttcttgtaaaccatttgatgaaaaagcggatggttatgctagacttgaaggtgcttgtatgcttttaattaaagattatgaaaaggctgtaagagataatgataagatttatgcttgtattattggtag

SEQ ID NO: 27221 - DNA, 510 bp, Neocallimastix californiae
  Thiolase-like_subgr
tggtactaatgaagatggtcgtacattatctataactatgccatcctcagatgctcaatgtactttaatgaagtgggtttgtgaaaaaagtaatatcaaggcagatactattgattatgttgaagctcatggtaccggtacaccaactggtgatccaattgaagccagatctattggtaatgcctttggtaaggctgttcgtgctccaggtagtaagccacttccagttggtactgttaaaggtaacgttggccatggtgaatttttaagtggtgcaattggtctcttgaaaacttcgttaatgcttttcaataaacaattagttccaacagcagcttttgaaaaattaaatccaaaaatagatgtcagtggtttaggtattcgtgttgcagataaaaatgaacctatggttaaacttaatggtaaagaaaataccccattgcgtgctgctgttaattcctttggttttggcggtgctaatgccaatgctattttagaatctgttgaaaa

SEQ ID NO: 27222 - DNA, 759 bp, Neocallimastix californiae
  Thiolase-like_subgr
tgttggtataattggtttagcatcttatattccaagtactaccgtaaatatgtctaagttagaagttcatgataattgtcaaggtaaatatacaattagtcttggtcaaaagtatatgtctttaactgctccaaatgaagatgtagtttctatggccttaaatgctgtgaagcgtttaatgaaaaagatgaacttaaagccaagtgatattggaagaattcaaattggtacagaaactcctgtagatttaagtaaaagtgtgaagacatttattgttgaacaattctttgatcaaggtattactgatattgaaggtgttgataatgttaatgcttgctttggttctactgcagctttattcgatactgttgcttggatgcaaagtgaattttggaatggtagatatgctattgttgttggaactgatatttcacaaggtgaagatatttatcacttccttacaggttcttccgctgttgctgtcttaattggcccaaatgctaacttagttgttgaaccaaatcgtggtatatttagtaatagtacttttgatttctataagccttatggatacaagaatcattatccagtagtagatggcaagtattctataaagtgttatcttgattccttaaagagttgctatgaagatcttaagaagaagacaaagtctgaaacagaattccttgatcatcaatttggtgtcttccataattctagtgtttctctaacaagaaaaggtttcaatactttaatgga

SEQ ID NO: 27223 - DNA, 798 bp, Neocallimastix californiae
  Thiolase-like_subgr
agccgaacaattcaagaagaagcatggagatcgtgttgatatctttgaaaatggtgaatctggtcaatggattgttaagattaagaagggatctaccatttacattccaaaggctcttcaatttgatagaactgttgctggtcaaattccaactggttggaagccagaaacctatggtattccaaagagtattattgatcaagttgatccaattaccctttatgttattgttgctactgttgaagctttagttagctctggtattactgatccatacgaattttacgaatatgttcatgtttctgaagttggaaactgttctggtggtggtgttggtggtatggtatccaaccgtaagcaatactttgaacgtctctttgaaaagccagttcaaaatgatattcttcaagaatgcttcatcaacactatgccagcttggattaatttattattactttcttcttctggtccaattaagacaccagttggtgcttgtgctactgccgttgaatctgttgaaattggtttagaaactatcttaagtggaaaggctaagattgttattgttggtggttacgatgacttccaagaagaaggttcctatgaatttgctaacatgaaggctaccagtaactccttagaagaattagctcatggacgtgatccatctgaaatgtctcgtccagctactactactagaggtggtttcatggaatctcaaggtgccggtcatgaaattttgatgacagcttctcttgctattaagatgggtgttccaatctacggtattattgctca

SEQ ID NO: 27224 - DNA, 393 bp, Neocallimastix californiae
  Thiolase-like_subgr
aagaggtgctcttgccgttttcggcttaactattgatgatattgaggcattatctttccatggtactggtacaaaggctaatgatactaatgaatccgaagtcattaacaagcaattcaaacatcttggtcgtagtaagggtaatgtttgtccagccatcatgcaaaagtacttaactggtcatccaaagggtgctgccgcttcttggatgcttaacggtatgcttcaagtcatcgaaactggtatcattccaggtaaccgtaatgccgataatattgaagaaaagcttcgtaaattcgaatacatctacttcccatctcgttccattcatacagatggtattaaggctggtttattaaagtctttcggtttcggtcaagttggtggtgaagt

SEQ ID NO: 27225 - DNA, 495 bp, Neocallimastix californiae
  Thiolase-like_subgr
cagtagtggtcaaagtggtttaagacaatcgattagtgcaccatcttctgatggtcaagtacttaacttgaagagagcacttaaatttgcaggtgttgatccatctgaagtttcttttgttgaagctcatggtactggtactccacttggtgatgccattgaagttgacgcccttaatcaagtttatggaggtagtcacaccgaagaaaatccattagtgattggtagtgtgaaaacaaacattggacatactaatgaagccgctggtttagctggtatggctaaggtcattttagccatgcaacataaatatattccaaagaatttacatttcaatacgcttaatccagaaattgatattcattccattccaattcaaattgctaccaaaaccatgccatgggaaacacaagataacaaaccacgtattgctcaagtatcttcctttggtttacaaggtagtattgttcatatcattcttcaagaatatattcc

SEQ ID NO: 27226 - DNA, 792 bp, Neocallimastix californiae
  Thiolase-like_subgr
tatggctcttcgtttacctggtgccatcaataattctaaatcgttctggatgtctttagccaaaggtagagattgtgtcttggctccagtcaaggatagaaaattacaccttggttatgtggataaaccatctaatcttttaggagaaaatgaacataatattccaaaatgtggttgctacgattctcgttcaaatgcagctaaaccttctgaatttgatgcagaattcttcaactgtttacctgaagaagtcaatagtatggatccaagacaacgttgggtcttagaaacgagttgggaagctttcgaaaatgcaggtattgctccaaataccttagaaaataccaccactggtgttttcgtgggtgtaaatgatgatcatgactatcaagatttattgaaagaaaacggtatcgctcaacctatttcagcacattctactccaagtggtattgctggccgtctcagttacttctataaacttttcggaccttcctttactatcgatactgcttgttctacaggtgcttctgccctccactctgcttgtcgttccttacaatttggagattgtgacttatcagtggtttccggagttaaatatttatattctgcctctgaattccatagaaccagtgttgctcgtatgacctctcctcatggtcgttgtgccacgtttgataaggatgctgatggttttgcaccaggtgaaggttgtgttacgtttattttgaagcgtcttgaagatgctgttcgtgatggagataatattctttcagttatccttggtac

SEQ ID NO: 27227 - DNA, 777 bp, Neocallimastix californiae
  Thiolase-like_subgr
tgctatcattggtacgggtattcgtttaccaggtgaaattaataataaggatgacttttggaaggtaatgaccgataaaaaggtgatcaccggtctcattccagaagatcgttgggatcgtgaagaatggtatagtaaggtcgaaaagccaggcaccatacaaacccttcatggaggtttcattgaaaatgctttcgatttcgataataaatattttggtatctctcaaaatgaagcgttggacgccactccagaacagagatggctatgtgaattaacggttgaaaccgttgaagatgccaatatggatatggatgattttaaaggaagtcatacgggggtctttgtgggtacctccggtatggattatggtagttatgtcttttctgttcctgaaaaaattactaaatatacgtacagtggtattgaaccttccatccatgctaatcgtgtctcgtatcttttcaatcttcatggtccatcgctttccactaataccgcttgttcctcttccatgaccgccttatccattgcttgtaattcgatggccgctggtgactgtgaaatggctttagttgccggtactaacttcttccaagccccagctaatggagtagcctattcgcaacttcgtgtcgtttcgaagaagggagcctgtcgtccatttgatattggtgctgatggttatgctcgtttagaaggtgccgccatggtcttgttgaagccatatgaaaaggccattaaggataataatcgtatttatgccactattttaag

SEQ ID NO: 27228 - DNA, 498 bp, Neocallimastix californiae
  Thiolase-like_subgr
cgcttgtaatgaagatggtaagacctcatccttgacaaccccatcctccgaagcgcaatgtcaactgatgaaacgtgtgtacagtaagggccacattgatccttgtaccattgattttgtggaagcccatggtaccggtacctctgttggtgatcccattgaagctcgatccatcggtgaagcctatggtaaggtgaataaggccaatggacatcctttactacccgtaggctcagtgaaaggtaatgtgggtcatggtgaatatttgagtggtatcgttggattaattaagggtgccctcatcctccacaagaataccattgttccacagaccgcgtttgagacgttgaatccaaagattcattgtgatgaactgggtatccgtattgctgataaggtggaacctcttccaggtaaaggacgtcatagagccgccgtcaactcatttggttttggtggtgctaatgccaacgtaattttagaggaggagcctcaagt

SEQ ID NO: 27229 - DNA, 795 bp, Neocallimastix californiae
  Thiolase-like_subgr
tatgggtttacgtcttccaggtgctattaataatgaaaagaccctctggtctgctttagttaaaggtagagattgtgtttccaatattccaaaggatcgtaaactccatgaatcctacgtaaataaaccatctaatgaacttaacccaggagaacataatgttaagaaatgtggttactacgactctcgtacctctggtgaaaaagtttctcaatttgatgctgaattctttaactgtcttccagaagaagccattggtcttgatccaaagcatcgttggattttagaaactagttgggaagccttagaaaatgctggtatctctccagattctcttgaagattccaacactggtgtctttgtcggtatcggtgatcagcaagaccatgcccaattcatgaaggaatgccataggaaaaaggttgtcagttaccacaacagtaatccatctgctattgctggtcgtctcagctacttctacaagctctatggtccttcagtgacagtggatactgcttgttccactggtgccaccgcccttcatacggcctgtcgctccatgatctatggtgattgtcgtctcgccatggtcactgcctctaagtatctcttttacccagaagaatttgaaatgaccagtaaggctagaatgacctctcctaatggtcgttgtgctaccttcgataaggacgctgatggttacgcgcccgctgaaggttgtgttaccttcatcttaaagtgcttagaagatgctgaacgtgataaggatcatattcttggtgttatcttaggaac

SEQ ID NO: 27230 - DNA, 495 bp, Neocallimastix californiae
  Thiolase-like_subgr
tagtagcggtcaaagtggcttccgtcaatccattagtgttccttcttttgaaggtcaagctagaaacattaagcgtgttatggaaattgctggggttaatccttccgatatctcctacgttgaaactcacggtaccggtaccccatacggtgatgccattgaaattcaaggtataaaccaggtctatgctggttcccatactcctgaacatccattagtcattggtagtatcaagaccaatattggtcataccgctgaaacctctggtttagccggaattgcaaaggttttagtggccatgaagaataagaccattccaagacaccttcacttcaagaccctcaatccagaaattgatttgaaatctgttccattagccattccaacccataatatgaaatgggaaactgaggaaggtaagccaagaactgctctcgtttcttcctatggtttacaaggtagtgccgtcaatattattcttcaggaatacattcc

SEQ ID NO: 27231 - DNA, 495 bp, Neocallimastix californiae
  Thiolase-like_subgr
tcaaagtggtttaagacaatctattagtgctccatcctcagaaggtcaagctattaatatgcgtaaggctatgaagtttgctggtattaaaccagaagatgtgtcatatgttgaagctcatggtactggtacaccattgggtgatgctcttgaagttcatgccttaaacgaaatttacggtggtagtcatactgaagaaaatccacttgttgttggtagtatcaagactaatattggtcacacttgtgaaactgctggtttagctggtattgctaaggtcattgtttcaatgcaacacaaacatattccaagaaaccttcacttcaataccttaaatccagaaattgatattaaatctattccaattcaaattccaaccaagaccttaccatggaactctactgaaccaaacaagccacttatcgctcaagtttcttcctatggtcttcaaggtagtattgttcatgtcttcttacaagaatatattccagaaaa

SEQ ID NO: 27232 - DNA, 795 bp, Neocallimastix californiae
  Thiolase-like_subgr
tggtatgggtcttcgtttacctggtgctattaacagtgcaaaatctctttggttagctttagctaagggtaaggattgtgttttacctccaattaaaactagagatttacatcgtaattacgttaataagccaagtgatcaattagatccaactgaacacaatattcctcgtttaggtttatacgatactagaaatagtgttgctaagccatctcaatttgatgctaagttcttcaattgtttaccagatgaagccttagctcttgatccaagacatcgttggattttagaaactagttgggaagccttagaaaatgctggtattccaccaaactctttagaaaattcttctactggtgtatttgttggtattaacgatgatcacgaatattctgatttattaactgaatgtggcgttaagagtccaattgctgctcatggtcaaagtccaagtggtattgctggtcgtttaagttacttctatagattatatggtccatccttcactatggatactgcttgttcaactggtgcttctgctcttcatactgcatgtcgttcattacaatgcggtgattgtgatttatctattgtttctggtgttaaattcatgtattcttccaaggatttctacatgacttgttctgctagaatgacttcaccacatggacgttgtgccacatttgataaggatgctgatggtttcgtaccaggtgaaggttgtgttaccttcatcttgaagcgtttagaagatgctgttcgtgacaatgatcacatcttatctgttgttttaag

SEQ ID NO: 27233 - DNA, 393 bp, Neocallimastix californiae
  Thiolase-like_subgr
aagaggagctcttgccgtctttggtttaactatggatgatattgatgctctctctttccatggtacaggtactaaggctaatgatactaatgaatcagaagttatcaacaaacaatttaaacatcttggtcgtagtaagggtaatgtttgcccagctattatgcaaaagtacttaaccggtcatccaaagggtgctgctgcttcctggatgcttaatggtatgcttcaagttatcgaaaccggtattatccctggtaatagaaatgccgataacatagaagaaaaacttcgtaaatttgattacatctacttcccatctcgttccattcatacggatggtgttaaggctggattattgaagtccttcggtttcggtcaagttggtggtgaagt

SEQ ID NO: 27234 - DNA, 825 bp, Neocallimastix californiae
  Thiolase-like_subgr
accaggatttgaatgtagtaaggaagaagcggaacaatttaagagaaagcatggcgatcgtgttgatatctttgaaaacggtgaatccggtcaatggaatgttaaatttaagaagggatcaactatctatattccaaaggctcttcaatttgatagaacagttgctggtcaaattccaacaggttggaaaccagaaacctacggtattccaaagagtattattgatcaagtggatccagttaccctttacgttattgttgctacggttgaagccttaattaactctggtattactgatccatatgaattctatgaatatgttcatgtttctgaagttggaaactgttctggtggtggtgttggtggtatgctttcttcccgtaaggaatactttgaacgtgcatttgagaagccaattcaaagtgatattcttcaagaatgtttcatcaatactatgccagcttggattaacttattgttactttcttcatctggtccaattaagactccagtcggtgcctgtgctactgctgttgaatctgttgaaattggtttagaaacgatcttaagtggaaaggctaagattgtaattgttggtggttacgatgacttccaagaagaaggttcctacgaatttgctaacatgaaggctacgagtaacgcattagatgaattagctcatggtcgtgatccatcggaaatgtctcgtccaggtacgactactagaggtggtttcatggaatcccaaggtgctggacatgaaatcttgatgaccgcctctcttgctattaagatgggtgttccaatctacggtatcattgctca

SEQ ID NO: 27235 - DNA, 816 bp, Neocallimastix californiae
  Thiolase-like_subgr
agttgctgtggttggtattgctttaagacttccaggtggtatcaacaccgttgataagtattggaaaagtttagaaagtggtagattctgtatctctccaactggtactaatcgtcttcttcatcacaacctgactcacaatgaacacttaaatcctggagaacattatattttcaactactgtcgttacgatagtacttctgacgtttcccctatcactgatttcgatccattgttctttaacatgaatccaagtgaggctaccgttctcgatccaaaattccgttgggtcttagaaactacttatgaagctttccaagatgccggtataaacccggataccctttctggtactcgtactaatgtatataccgctccaggtcaagttgatgaaatgaatacctacactattgatgcctccccaaccggttacagtattcttaacggtatgagtatgcacagttgtgctgctgcttctttaccaggtagaattagtttcatgtataacttgtacggtgctgcccacactgtagataccgcttgttcttccggtttagtagctactcatgatgctttcaaggatttaaacatcggtgaaactgatcttgctatcgttaatgctgctcactgtccatttcaaagtagtggtttcagtcttttgtctgttgctaagatggtttcaagaaattgtagatgtgctgcttacgatgaagccgctgatggatatgttcctggtgaaggttgtgtctccattatcttaaagagaaaagatgatgccatccgtgatcacaacaaaatttatggtttaattaatgc

SEQ ID NO: 27236 - DNA, 495 bp, Neocallimastix californiae
  Thiolase-like_subgr
agctgtcggtcaaagtggttcaagagcttctatgagtacaccatctgctattggtcaaaagatcattcatgaagaagtcttaaagaatgccaaccttactccaaaagatattgactatatggaaggtcatggtactggtacaaaattaggagatcgtattgaaggagaagccatcaatgaagttttcaagggatctcactctgaaagtcgtccattaacattagctagcgttaagactaacattggtcacactgaagaagttagtggtttagcctctcttgttaaggtcttattagccatgaaatacaagaccattccacctcaccttcacttccataaaccaagttcctccattgatttcgattctgttccattacacattccaactcaaaaggaagaatggaaagcccatgacggtaagaatcgtattgccctcgtttcttcctacggtctttccggtagtgtctgtgatgctgttgttgaagaatacgttga

SEQ ID NO: 27237 - DNA, 498 bp, Neocallimastix californiae
  Thiolase-like_subgr
tagtaatggacaaagtggaggacgtcaatccatttctgttccatcttctgaagctcaagttcgtaatattaaaaatgcattaaaagatgctcatgtatctccaaaagatatatcgttcgttgaagcccatggtaccggtaccccttatggtgatgcaatagaaattcatgccttaaatcaaattttcaaagattcacattccaaaaaatcacccttatatattggaagtgtcaaaactaacataggacatacctgtgaagcagctggattagccggtattgttaaagtcttactctccatgaagcataatgtcattccaaaacatattaactttaaaaagttaaatcctgaaattgatttaagtatggttccattttgtattcctagtcaaaagaatattcgttggacatctccagatccttctaaaccgttaattgccgaggtctcttcctatgggttacagggaagtatcaccaacgttatacttcaacaatatct

SEQ ID NO: 27238 - DNA, 861 bp, Neocallimastix californiae
  Thiolase-like_subgr
tgattgccaaaatcgtattgctattgttggtataggattacgtcttccaggaggtattaattcaaccaaaaagttctggttttcattaattaaaggtaagaattgcttatcagctacaccaacggatcgcgaacttcatttaggaatggtagatatgagtaagaagccaccggaatatcgactaaataaaaatgaacattatgtttgtagatatggtatttatgattctcattatgcctcatctggagtaaagtacactgattttgatgctaatttctttgactgctctaccgaggaagctattagcatggatgtcaagcagcgttggatgcttgaaacaagttgggaagctttagaagatgccggtatagatccttcctccatcgaaaattctgataccggagtattcataggaatgaacaattgctatcatcaaacaaagcttttgtcctccaagaaagccactaacattagctcttctttcaatccaaccacccttcattgtacagatctttcatcagtagctggacgaatttcctatttctataagatatacggaccagccatttctatggatactgcatgctcaacaggagctaccgcactacatacagcgtatcgttctatgcaatatggtgaatgtgatttagctattgtatccggggctcgatttctttactacaatgacgaatttattaatacttctcatgctaaaatggcatcaccaaatggacgttgtgccacttttgatgaagatgcggatggatttgcacctgcagaaggttgtgtgaccctcatcttaaaaagactagatagagctgaagaaaataatgataatatttatggtatacttctaggtag

SEQ ID NO: 27239 - DNA, 498 bp, Neocallimastix californiae; identical to SEQ ID NO: 27237
  Thiolase-like_subgr

SEQ ID NO: 27240 - DNA, 861 bp, Neocallimastix californiae; identical to SEQ ID NO: 27238
  Thiolase-like_subgr

SEQ ID NO: 27241 - DNA, 498 bp, Neocallimastix californiae
  Thiolase-like_subgr
tagtaatggtcaaagtggaggacgtcaatcaatttctgttccttcctcagaagctcaagtacgtaatattagaaatgcactaatggatgctcaaatctctccaaaggacatttcatacattgaagcccatggtactggaactccatatggtgatgcgttggaaattcacgctttaaatcaagtttttggagaaagccatactaaaaattcaccattgtatattggtagtgtgaaaactaatataggacatacctgtgaagcagcagggttagcaggaattgttaaagttttactatccatgaaacatcaaataattccaaagcatattaattttaaaaagttaaatcctgaaatcgatttagaaactattccactttgtattcctagtcaaaaaaatattcattggacgtcttcagatccttctaagcctttaattgcacaaatctcctcttatggtttacaaggaagtgttacaaatattattcttcaacaatatct

SEQ ID NO: 27242 - DNA, 858 bp, Neocallimastix californiae
  Thiolase-like_subgr
taatcataatcgaattgctatagttggtataggattacgtcttccaggtggcatcaattcaaccaaaaaattctggcattcattattacaagggaaaaattgtttatccactacacctgttgatcgtcaacttcacctgggaatgatagatatggctaaacaacaacctggatataaattaaataaaaatgaacactatattcacaaatatggttattatgattcaattcatacggcttctatagcaaagcctacaaagtttgatgctaatttctttgaatgtactaatgaagaagctattggaatggatgttaagcaacgatggatgctggagactagttgggaagctttagaagatgctggtattgatccttcaactcttgaaaattcaaatacaggtgtatttattggaatgaataactccaatcatcatataaaacttttatcttcagagaaagccactaatgtaggacctaacttcagttcagtcacacttcatggtactgatctttcttcagctgcaggtcgtatttcttatttctataagttatatggcccagcaatttccatagatacagcatgttcaacaggagctacagcattgcatactgcctatcgatctatgcaatatggtgattgtgatctagcaatagtttcaggtgctcgattcctttactataacgatgaatttattaatatttctcatgctaagatgacttcacctaaaggacgttgtgcaactttcgatgaaagtgctgatgggtttgcacctgccgagggttgtgtaacattaattttaaaaagacttgatgatgctgaagaaagtaatgatgacatttatggtattctccttggtag

SEQ ID NO: 27243 - DNA, 498 bp, Neocallimastix californiae
  Thiolase-like_subgr
ggaagctttagaaaatgctggtattgctccaaattctctagaaaatactttaactggtgtctatgtcggtattaataatgaacatgagcatgaagatttattaaaaaaatgtggtatcgttccaccccttggttcccataccttaaatcaaagcagtattgctggtcgtttaagttatttttataaactttttggtccatccttcaccattgataccgcttgttccacaggttcttctgctcttcatattgcttgtaatgctatgaaacgtggagaatgtgatttatctattgttacgggtgtgaaatatatgtactcctccaaagaatttcataaaacctgttctgcccatatgacttctccaaagggtcgttgtgccacttttgacgccagtgctgatggttttgctcaaagtgaaggttgtgttacttttgttttgaaacgtttggatgacgctattcgcgataaagataatattttaacagttattcttggttc

SEQ ID NO: 27244 - DNA, 195 bp, Neocallimastix californiae
  Thiolase-like_subgr
agttagtggtcaaagtggtttaagacaatcaattagcgctccttcctacgaaggtcaagctctcaacatcgaaagagcaatgaaaattgcaggtatcagtccagatcaagtatcctatgttgaagctcatggtactggtactcccttaggagatgctattgaaattcatgccctgaatgaagtctatgctggtag

SEQ ID NO: 27245 - DNA, 678 bp, Anaeromyces robustus
  Thiolase-like_subgr
atttgatcgtttagtttctggtcaattaccaaccggttgggatccagctcgttatggtattccaaaggatattatagaacaagtagatccaattacatgttattgtattgtttctgctgtagaagctttagttagtgcaggtattactgatccttatgaattttatgaatatgttcatgtttctgaagtcggaaatgcttgtggttcaggtgttggtgctgaaattgctaatcgtgctattttcaaggatcgtttcttggataaaccacttcaaagtgatattcttcaagaaacctttgttaatactatgagtgcttggattaatttattattactttcctcttctggtccaattcgtactccagttggtgcttgtgcctctgctgttgaatctgttgatattggtattgataccattttatctggtaaggctaaggttgtctttgttggtggttatgatgatttccaagaagaaggttcctatgaatttgctcaaatgaaggctacttctaattcacgtgaagaaatggctcaaggtcgtgaaccagatgaaatgtctagaccaaccgcttcctctcgtggtggttttatggaatctcaaggtgttggtactcaagttttaatgccagctagtttagccttaaagatgggtgtaccaatttatggtattattgctca

SEQ ID NO: 27246 - DNA, 381 bp, Anaeromyces robustus
  Thiolase-like_subgr
acgtggtgctttagccgcctttggtcttactgttgatgatattggtgttgcttccttccatggtacaggtacaaaggctaatgataagaatgaatcagatgtctttaataaacaatttgaacatttaggacgtactaaaggtaatgcttgtccagttgtatgtcaaaagtatcttactggtcatggtaagggtgctgctgctgcttggatgttgaatggtgttattcaaattattcaaactggtattattccaggtaatcgtaatgctgataatattgatccacttttagaaaagtttgatcatctttggttcaataataaaactttcaaaactccaggtgttaaagctggtttattaaaatcctttggttttggtcaagt

SEQ ID NO: 27247 - DNA, 501 bp, Anaeromyces robustus
  Thiolase-like_subgr
tagtagtggacaaagtggtattagacaatctattagtgccccatcttcagatggacaagttattaatttaaaaagagctcttcattttgctggtgtcgatccatccgatatttcatttgttgaaactcatggtacaggtacaccacttggggatgctattgaagttaatgctttaaatcaagtttataaaggaactcatacttctgagaatccattaattattggtagtgttaaaactaatattggtcatacaacagaagttgcaggtttagcaggtgttgctaaagttattttatctatgcaacataaatatattccaaagaatttacatttcaatacattaaatccagaaattgatattgaatctattccaattcaaattgctactaaaactataccatgggaaaataaaaataataaaccacgtattgctcaagtttcatcctttggtttacaaggaagtattgttcatattattcttcaagaataccttccagaaaa

SEQ ID NO: 27248 - DNA, 795 bp, Anaeromyces robustus
  Thiolase-like_subgr
tggtatggctttacgtttaccaggagctattaataatgctaaatctttctggatggctttagctaaaggtaaagattgtatttctacaccagttaaagatagaaaattacatcttggttatgtgaataagccatcccatcttttaaatgaaaatgaacataatattcctcgttgtggttgttatgattcacgttcaaatgttgctaaaccttctgaatttgatgcagaattctttaattgtcttccagaagaagctatggctcttgatccaagacatcgttggatattagaaacaagttgggaagctttagaaaattcaggtattgcaccaaattcattagaaaataccattactggtgttttccttggtataaatgatagtcatgattatcatgatttaatgaaagaaaatggtattacaccacctattgctgcccattctacaccaagtggtattgttggacgtcttagttatttctataaattatttggaccttctttcacgattgataccgcttgttctactggtgcttctgctttacattctgcctgtcgttcattacaatttggagattgtgatttatctattgtttccggtgttaaatatttatatacttcaaatgatttccatagaacaagtattgcacgtatgacttcaccaaagggaagatgtgctacttttgataaagatgctgatggatttgttccaagtgaaggatgtgttacttttattcttaaacgttatgaagatgctattcgtgatcatgataatattctttctgttatattaggtac

SEQ ID NO: 27249 - DNA, 504 bp, Anaeromyces robustus
  Thiolase-like_subgr
tagtagtggacaaagtggtattagacaatctattagtgccccatcttcagatggacaagttattaatttaaaaagagctcttcattttgctggtgtcaatccatccgatatttcatttgttgaaactcatggtacaggtacaccacttggtgatgctattgaagttaatgctttaaatcaagtttataaaggaactcatacttctgaaaatccattagttattggtagtgttaaaactaatattggtcatacaacagaagttgctggtttagcaggtgttgctaaagttattttatctatgcaacataaatatattccaaagaatttacatttcaatacattaaatccagaaattgatattgaatctattccaattcaaattgctactaaaactataccatgggaaaataaaaataataaaccacgtattgctcaagtttcatcctttggtttacaaggaagtattgttcatattattcttcaagaatacattccagaaaagga

SEQ ID NO: 27250 - DNA, 795 bp, Anaeromyces robustus
  Thiolase-like_subgr
tggtatggctttacgtttaccaggtgctattaataatgctaaatctttctggatggctttagctaaaggtaaagattgtgttactacaccagttaaagatagaaaattacatcttggttatgtggataagccttcacatcttttaggtgaaaatgaacataatattcctcgttgtggttgttatgatacacgttcaaatgttgctaaaccttctgaatttgatgctgaattctttaattgtcttccagaagaagctatggctcttgatccaagacatcgttggatattagaaacaagttgggaagctttagaaaattcaggtattgcaccaaattcattagaaaatacaattactggtgttttccttggtataaatgatagtcatgattatcatgatttaatgaaagaaaatggtattacaccacctattgctgcacattctacaccaagtggtattgttggacgtcttagttatttctataaattatttggaccttctttcactattgataccgcttgttccactggtgcttctgctttacattctgcttgtcgttcattacaatttggagattgtgatttatctattgtttcaggtgttaaatatttatatacttcaaatgacttccatagaacaagtattgcacgtatgacttcaccaaagggaagatgtgctacttttgataaagatgctgatggatttgctccaggtgaaggatgtgttacttttattcttaaacgttatgaagatgctattcgtgatcatgataatattctttctgttatattaggtac

SEQ ID NO: 27251 - DNA, 780 bp, Anaeromyces robustus
  Thiolase-like_subgr
tgctattattggtataggttgtcatttccctgaaggtatagaatcaaaagaagatttttggcaaatgcttgaagatgctcgttgtattaccaaagatataccaaaagaaagatgggataaagatgaatggtattctgaggaacctattcaaggtactattcaaacaaaacgtggtgcctttttaaagaatccttatctttttgataataaatatttctatatttctatgccagaagctaaagaaatgtcaccagaacaacgttggcttttagaattaactgtggaaactttagaagatgctaatataaaaccagaaactttgaaaggtactcgtactggtgtttttattggttcttctggttgtgattatttagctacacagatttctcatgctaatgatattaattctcattctcctactggatttgaactttcaattttagctaatcgtttatcctatgtatttgatttacaaggtccatcgattagttgtaatacagcatgttcttctgcgttttcagcattaaatattggtttaaatgctatgattactgatgattgtgaaatggcgcttgtagctggttctaatttcatgaattgccctggtggatttgttgctttttctcaacttcgtgtagtatcacctgatggttcttgtaaaccatttgatgaaaaagccaatggttatgctagattagaaggtgcaggtatggtattaattaaaccttatgaaaaggcagttcgtgatggggataaaatttattgtgctattgttggatg

SEQ ID NO: 27252 - DNA, 504 bp, Anaeromyces robustus
  Thiolase-like_subgr
tggaagtaatgaagatggtcgttcaccttcccttactatgccatcttatgaagctcaatataaacttttaactcatgtttgtgaaaaatcgggtattcatccaactcaaattgattatgtagaagctcatggtacaggtacaaaagtaggtgaccccattgaatcacgggctattggtgatgcttatggtaaaagtaaaggtattcgtggtccaaatgatccaccaattttaattagttctgttaaaggtaatacaggacatggtgaaaattctagtggtatagtaagtattattaaaacttctatgatgcttcataaacgtcgtctcgtacccactgtagcttatcatcatatgaatccagccattaatgcagaaaaattaggtattaaagtatgtgaaactttagaagattggaaaacaccacatttattacatgctgctgttaattcctttggatttggtggtgctaatactaatactatattagaggaagtacctcattt

SEQ ID NO: 27253 - DNA, 504 bp, Anaeromyces robustus
  Thiolase-like_subgr
tagtagtggtcaaagtggtttaagacaatccattagtgctccatcctccgaaggacaagctataaatattaaaagagctatggaaattgcagatattaaaccagaagatgtttcctatgttgaagcccatggtacaggtacaccattaggtgatgcattagaaattcattccttaaatcaagtttatgctggtagtcataatgaagaaaatccattagttgttggtagtgttaaaactaatattggacacacaggtgaagttgccggtttagctagtattgctaaagttattttagctatgcaacataaacatattcctaagaatcttcatttcaatactttaaatccagaaattgatattgaatctattccaattaagattccaactaaaactataccatggacatcaccagttcctaataaaccattaattgctcaagtttcatcatttggtcttcaaggtagtattgttcatcttttccttgaagaatatattccaaaaga

SEQ ID NO: 27254 - DNA, 792 bp, Anaeromyces robustus
  Thiolase-like_subgr
gtctttacgtttaccaggttcaattaatagtgctaaatccttctggatggctttagctaaaggtaagaattgtgttttaccacctgttaaaaatagagatttacatcatggttatgttaataaaccaagtgatcaattaaatccaggggaacataatattccatatattggttgttacgatactagatctaatgttgcaaaaccatcccaatttgatgctgaattctttaattgtttaccagatgaagcattagcacttgatccaagacatcgttgggtattagaaactagttgggaagcattagaaaatgcaggtattccaccaaattcattagaagattcacttacaggagtatttgttggtatgagtcaagatcatgaatatgctgatttattagctgaacgtaatattatagctcctattgctgctcattctaatactcaaagtggtattgcaggacgtttaagttatttctatcgtttatatggtccatcattaactatggatactgcctgttctactggtggatcagctattcatactgccgttcgttccttacaaaatagagattgtaatttatccattgtttcatgtgtaagatacatgtatacctccaagactttctataaaacatgtgctgcaagaatgacatctcctcatggacgttgtgcaacatttgataaagatgctgatggatttgcttctggtgaaggatgtgtttgtttcgttttaaaacgtttagatgatgctattcgtgataatgatcatattttaagtgttattataggtac

SEQ ID NO: 27255 - DNA, 495 bp, Anaeromyces robustus
  Thiolase-like_subgr
ttctacagctcaatcaggtactagacgttctatttctactccagctgttggcccacaagcagaaaatatgagaagagttttatctatggctaatattaatgcatctgatgttgattatcttgaagctcatggtactggtactccagtaggtgatgctattgaaactgaaactttaaatcttgttttcggtaaaactcataccgaaaagaaacctttaattgttggtagtgttaagactaacttaggtcacacagaagaagtttctggtttagctggtttatgtaaagttcttttatctatgtcacatcgtataattccaccacatcttcacttaaagaacttaaatccacgtattgatctttctgttattccaatgactattccacaaaagaaatgcatttggaagagtccacgtggtaaaaagagaattggtgttgtttcctcttttggtttacaaggtagtattgctaatgctgttgttgaagaatttaaact

SEQ ID NO: 27256 - DNA, 822 bp, Anaeromyces robustus
  Thiolase-like_subgr
aattgcagttattggtatgggtattcgtttaccaggtggtattaatacccctggaaaatattggtctgctttagttagtggtagagattgtacatcaccaacaccaactaatcgtcaccttcaccactatttaaaaccaggatgtccagccaatgaattaggaccaatggaacattatatccatcgtggtggtttctatgataccactccagatgctgctccacttagtgattttgatccaacttttttcaacatttcaccattagaagctaaagctacagatccaaaatttcgttgggtttatgaaactgtttatgaagcttttcaagatgcatgtattaatatatctgaattaaatggatctcgtactagtgtttattgtactgtaggtcaaattttggattatgtttctgtagctagagctttcaacaaaagtgaaaatatgacaagtcaaactatgcatggaagtaatccttctagttgtgctggtcgtattgcttttaattatggtttcaccggtccatctgatactattgataccgcttgttcaagtggtttaaatgatgttaacaatgcttgtaaggccctttcttgtggtgatactgatttagctgttgtttcagctgttcatcaacaaattattggtactcaatttcatgttatttctgttgctcaaatggcttctcatcttggtcgttgtgctactttcgatgctgaagctgatggttatgctccaggtgaaggatgtattagtcttattcttaagcgtttagacgaagctgttactgatcatgaccgtatttatggtgttattactggtat

SEQ ID NO: 27257 - DNA, 492 bp, Anaeromyces robustus
  Thiolase-like_subgr
tgttggtcaaagtggttccagatcttctatgagtactccaactgttgaaggtcaatctagaattcataaggaagttttaaaattagctcatcttgaaccaaaagatattgattatatggaaggtcatggtacaggtacaagtttaggtgaccgtattgaaggtgaagctattaaccttattttcaaaggtactcactctgaaactcgtccattaactttagctagtgttaaaaccaatattggtcatactgaagaagttagtggtttagcttctcttgttaaagttttattagctatgaaaaataagactgttccaccacatcttcatttccataatccaaatccttcaattgatttcaaatctgttccattacatattccaactcaagttgaagaatggaaaccagttgaaggtaagaagcgtgttgctttagtttcttcttatggtctttctggaagtgtttgtgatgctgtcgttgaagaatatgttga

SEQ ID NO: 27258 - DNA, 816 bp, Anaeromyces robustus
  Thiolase-like_subgr
agttgcagttgttggtattgctttaagacttccaggtggtataaatacagttgataaatattgggatgttttagttaatggaaaattctgtgctactccaactggtactaaccgtcatcttcatcattatatgactacagctgaacatttaaaaccaggagaacattatgttactaaatattgtcgttatgatagtactccagatgcagctccaataactgattttgatccaatgttctttaatatgaatccaagtgaagctgctgctcttgatccaaaattccgttgggttttagaaactacatatgaagctttacaagatgcttgcattaatccagattctctttctggtactcgtactaatatttatactgcaccaggtcaagttcatgaaatgaataattatactactagtgcttcaccaactggttttagtgtacttaatggtcaaagtatgcatggtgttgcttgtgcttctttaccaggtagaattagttttatgtataacttatatggtgctgcccatacagttgatactgcttgttcttctggtttagttgctgctcatgatgcttttaaagatttaaatattggtgaaactgatcttgctattgttaatgccgctcattgtccatttataggtagtggtttcagtcttttatctattgctcaaatggtttctagaaattgtagatgtgctgcttatgatgaagctgctgatggttatgttccaggtgaaggttgtgttaccgtcattttaaagagaaaagatgatgctattcgtgatcataataagatttatggtttaattaatgc

SEQ ID NO: 27259 - DNA, 798 bp, Anaeromyces robustus
  Thiolase-like_subgr
agctgaacaatttaagaagaagcatggtgatcatattgatatctttgaaaatactgaatctggtcaatggattgttaaggttaaaaagggatctactatctttattccaaaggctcttcaatttgatcgtactgttgctgctcaaattccaacaggttggaaaccagaaacttatggtgttccaaagaatattattgatcaagttgatccaattaccctttatgttattgttgctactgtagaagcacttgttagttctggtattactgatccatatgaattctatgaatatgttcatgtttctgaagttggtaattgttctggtggtggtgttggtggtatggtttccactcataaagaatactttgatcgtgcttttgaaaaaccagttcaaagtgatattcttcaagaaagctttattaatactatgccagcttggattaatcttttattactttcttcttcaggtccaatcaagactccagttggtgcttgtgctactgctgtagaatctgtagatattggtgttgaaaccattttaagtggtaaggctaagattgttattgttggtggttatgatgatttccaagaagaaggttcttatgaatttgctcaaatgaaggctactagtaattcattagatgaattagctcatggtcgtgatccatctgaaatgtctcgtccagctactactactagatctggtttcatggaagctcaaggtgctggtcatgaaattttaatgaaagctagtcttgctattaagatgggtgtaccaatttatggtattattgctca

SEQ ID NO: 27260 - DNA, 393 bp, Anaeromyces robustus
  Thiolase-like_subgr
aagaggtgctcttgctgtctttggtttaactattgatgatattgatgccttatctttccatggtactggtactaaggctaatgatactaatgaatctgaagttattaataaacaatttaaacatcttggacgtagtaaaggtaatgtttgtccagctattatgcaaaagtatttaactggtcatccaaagggtgctgctgcttcatggatgcttaatggtatgcttcaagttattgaaactggtattattccaggtaatcgtaatgctgataatattgaagaaaaacttcgtaagtatgaatatatttgttacccatcacgttcaattcatactgatggtgttaaggctggtttattaaaatccttcggttttggtcaagttggtggtgaagt

SEQ ID NO: 27261 - DNA, 780 bp, Anaeromyces robustus
  Thiolase-like_subgr
tgctattattggtgttggttgtcgtttaccaggtgatattactaccaaagaagacttttggaatatgttagttactaaacgtgttgttacatcagagattccagctgatcgttgggatcgtgaagaatggtatagtaaggaaccaatcccaggtactattcaaactaaacatggtggtttcctttctaatgcttatgactttgataataaatatttttctatttctcaagctgaagcacttgaaattactccagaacaacgttggttatgtgaacttgctgttgaaaccatggaagatgctaatatacgtccagaagaattaaagggtagtcaaacaggtgtatttgttggttcagcaggtattgattttggtggtaaccaattagtaaatacattacaaatgtctgcacacactatgactggtttagaaccatcaattttttctaatcgtatttcttacatttttgatttacatggtccatccattactagtaatacggcttgttcagcttctatgtcttcattatctatggcttgtaatgctatagcagttggtgattgtgataaggcttttgttgctggttctaatttcttacctactcctggtggttatgttgctttctcacaacttagagttgtttcaaagactggttcatgtaaaccatttgatgaaaaagctgatggttatgctagacttgaaggtgcttgtatgttattgattaaagattatgaaaaggcgattagagataatgataagatttatgctacaattattggtag

SEQ ID NO: 27262 - DNA, 510 bp, Anaeromyces robustus
  Thiolase-like_subgr
tggtaccaatgaagatggtcgtacattatctattacccttccttcctctgatgctcaatgtgctttaatgaaatgggtatgtgaaaagagtaatattaaggctgatactattgattatgttgaagctcatggtactggaactccaactggtgatccaattgaagccagatctattggtaatgcttttggtaaggttgttcgtactccaggaagtaaacctcttccagtaggtacagttaaaggtaatgttggtcatggtgaatttttaagtggtgctattggtttattaaagacttctttaatgcttttcaataagcagttagttccaactgctgcttatgaaaaattaaatccaaaaattgatgttaatggattaggtattcgtgttgctgataaaaatgagccaatgataaaaattaatggtaaggttaatactccattacgtgctgcagttaactcttttggttttggtggtgctaatgctaatgctattttagaagctgttgaatc

SEQ ID NO: 27263 - DNA, 765 bp, Anaeromyces robustus
  Thiolase-like_subgr
tattggtattattggtttagcaacttatattccagcaacaactgttagtatgacaaaattagaagctcatgataaatgtcaaggtaaatatactattagtttaggccaaaagtatatgtcattaactgctccaaatgaagatgttgtatctatggccttaaatgctgttaaacgtttaatgaaaaaaatgaatttaaaaccaagtgatattggtagaattcaaattggtactgaaacaccagtagatttaagtaaaagtgttaaaacatttattgtagagcaattctttgaacaaggtattactgatattgaaggtgttgataatgttaatgcttgttttggttctactgctgctttatttgatactgttgcttggatgcaaagtgatttctggaatggtagatatgctattgttgttggtacagatatttctcaaggtgaagatatttatcacttccttacaggttcatcagctgttgctgttttaattggtccaaatgctaatttagttgttgaaccaaatcgtggtattttcagtaatagtacttttgatttctataagccatatggttataaaaatcattatccagtggttgatggtaaatattctattgattgttatcttaattctttagttagttgttatgaagatcttaaaaagaaatctaaatctgaaacagaattccttgatcatcaatttggtgttttccataattctagtgttagtttaacaagaaaaggtttcaatactttaattgaaaagga

SEQ ID NO: 27264 - DNA, 819 bp, Anaeromyces robustus
  Thiolase-like_subgr
ttatgaaaaaattgctattattggtatggctcttcgtttaccaggtgcaattaataatgctaaatctttatggatgactttacttaaaggtaaaaattgtgttgtagccccagttaaaaatagagatttacatactaattatgttaataaaccaagtaatcaattacttccaaatgaacataatattccatattttggttgttatgatactaaatctaatgttgctaaaccttcacaatttgatgctgaattctttaattgtttaccagatgaagctttatcacttgatccaagacatcgttggattttagaaacaacttgggaagctttagaaaatgctggtataccaattaattctttaaaaaatacaactactggtgtttttgttggtattaatgatgatcatgaatattcagatttattagaagaaaatggtatttctattcctatttcttctcattctaatcatccaagtgatattgctggtcgtttaagttatttttataatttatatggtccatcttatactatggatacggcttgttctacaggtgcttcagctattcatgtagcttgtcgttccttacaaaatagagattgtaatttatgtatggttactggtgttaaatatatgtattcttcaaaatctttaagtaaagcttgttcagctagaatgatttcccctcatggtcgttgtgctacttttgatatagatgccgatggatttgtaccaggtgaaggttgtgttacatatattttaaaacgtttaaatgatgctattgaagataatgataatattttatctgttattattggtag

SEQ ID NO: 27265 - DNA, 498 bp, Anaeromyces robustus
  Thiolase-like_subgr
tagtagtggtcaaagtggattaagacaatccattagtgcaccatcatcagaaggtcaagctcttaatattcgtaaagctatggaatttgctcaagttaaaccagaagatatttcttatgttgaagctcatggtacaggtaccccattaggagatgctatggaaattcatgctttaaatgaagtttatgctggtactcattcaaaagaaaatccattaattgttggtagtattaaaactaatattggtcatacttgtgaagttgctggattagcaggattagctaaagttattgtttcattacaacataaacatataccaagaaatcttcatttcaataaacctaatccagattttgatcttaattctattcctattaaaattccaacaaaaactcttccatggaattcattaaaacctggaaaaccacttatagcacaagtttcttcctttggtcttcaaggtagtattattcatcttattattgaagaatatattcc

SEQ ID NO: 27266 - DNA, 849 bp, Anaeromyces robustus
  Thiolase-like_subgr
aacggataatcttatagctattgtaggtattggattacgtctaccaggtggtattaattcaactcaaaaattttggctttctcttattaaaggaagaaattgtttatcaaatactccaactgatcgtcaattacatcaaggttttgttgatatgcaaaaaaatccaaataaaaatttagatattaatgaacattatattggtaaatatggctattatgaatctgttcgtggtaccgcaaaacccacagattttgatgcagatttttttgaatgttctaaagatgaagctattggtatggatgttaaacaacgttggatacttgaaacaagttgggaagctttagaagatgcaggtattgatccatctattattgaaaattctaatactggtatatttgtaggtatgaataattgtaatcatcacgtaaaattaatggcctctaaggaagctaccaatattaattcaaattataatagtattactactcatggaacagaattatgttctgtagcaggtcgtctttcctatttttataaattatatggacctgctatatcgattgatacagcatgttctacaggagcaacagcagtacatgttgcttgtcgttcaattcaaatgggagaatgtgatttagctattgtttcaggagctcgatatctttattataatgatgaatttattaatacatcacatgcaaaaatgacatcaccaaataatcgttgtgctacatttgatgaatcagcggatggatttgcatcttctgaaggatgtgttaccttaattcttaaaagattagatgaagcagaagaaaataatgataatatctatggagttattcttggatc

SEQ ID NO: 27267 - DNA, 498 bp, Anaeromyces robustus
  Thiolase-like_subgr
aagtaatggacaaagtggaggaagacaatcaatttcagtaccatcatcagaagcacaagaacgtaatattcgaaatgcaatgaaaaatgcaaatgtatctcctaaagatatttcatatattgaagctcatggtactggtactccctatggagatgcattagaaattcatgctattaatcaaatatttggacatactcatactcaagattctcctctttatatcggtagtgtaaaaacaaatataggacatacatgtgaagcatcaggattagcaggacttgtaaaagttttattatccatgaaacatcaattaataccaaaacatataaatttccgtaaaattaatccagaaattaatttagatcttgtaccattaaatataccttatcaaaaatgtattccatggaaatcttcggatccaacaaaacctttaattgcagaagtttctagttatggattacaaggtagtgtaacaaacattatcttacaacaatatat

SEQ ID NO: 27268 - DNA, 825 bp, Piromyces finnis
  Thiolase-like_subgr
tcaagttcaaattgctgttgttggtattgcgttaagacttccaggaggtataaatactgttgacaaatactggaatagcttagttgatggtagattctgtatctcaccaattggtacaaatcgtcaccttcaccactacatgtctaaagaagaaaacttaaagccaggagaacattatatttacaactatggtcgttatgattctaccccagatgctgccccaatttctgactttgatccaatgttcttcaacatgaacccaaatgaagcctctgctcttgatccaaagttccgttgggttttagaaactacttatgaagccttccaagatgcaggtattgatccagatgtcctttctggaactaatactagtgtatacactgctccaggtcaagtcgatgaaatgaatagatatgctattcttgcttctgatactggcttcagtgttcttaatggtatgagtatgcatagttgtgctgctgcttctttacctggtagaatcagtttcatgtataatttacttggtgctgcccacaccgttgatactgcttgttcttccggtttagttgctactcatgatgccgtcaaggacttaaaccttggtgaaactgatcttgctattgttaatgccgctcactgtccattcatgagctccggtttcagtcttttatctgtcgcaaagatggtctcaagaaactgtagatgtgctgcttatgatgaagctgctgatggttatgttcctggtgaaggttgtgtcactatcattttaaagagaaaagatgatgctattcgtgatcacaacaaaatttatggtttaattaatgc

SEQ ID NO: 27269 - DNA, 495 bp, Piromyces finnis
  Thiolase-like_subgr
tgttggtcaaagtggttctagagcttctatgagttctccaactgttattggtcaaaccaatattcataaacaagttttaaaaaaggctggtgttaatccaagtgacattgactatatggaaggtcacggtacaggtacaaaattaggtgatcgtattgaagcagaagctatcaacaatgtctttaagggtagtcactctaaggaacgtccattagttttagctagtgttaaaactaacattggtcatactgaagaagttagtggtttagcttctcttgttaaagtattattagctatgaaaaacaagactgttgcccctcatcttcatttcaaaaatccaagtcctttaattgatttcgattctgttccattacacattccaactcaaaaggaagaatggaaaccagctgaaggaaagaaacgtactgctttaatttcttcatacggtctttctggtagtgtcagcgatgttattgtggaagaatacattgaacc

SEQ ID NO: 27270 - DNA, 507 bp, Piromyces finnis
  Thiolase-like_subgr
cgctagtggtcaaagtggtttaagacaatctattagtgctccttcttctgaaggtcagactgttagcattaagagagctatggaaaaagccggtattacaccagaacaagttagtttcgttgaagctcacggtactggtacaccattaggtgatgcacttgaagtccatgctcttaatcaagtttatggtggcagtcacactgaagaaaatccattaattgttggtagtattaagtccaatattggacacacatgtgaagctgctggtctagccagtattgctaaggttatcgttgctatgaagtataatcttattccaagaaatattcactttaatgaacttaatccagaaattgatctttcaactattccaatgaaaattccaaccaaaacattaccatggaatccaccaaatgatgatacaccacttattgctcaagtatcttcctttggtttacaaggtagcattattgtcaccttcttagaacaatatgttccagaaaagaa

SEQ ID NO: 27271 - DNA, 795 bp, Piromyces finnis
  Thiolase-like_subgr
tatggcacttcgtttacctggtgctatcaataactcaaaatctttatggatggctttagcaaagggtaaagattgtgtattacctccagttaaaactagagatttacacactcgctatgctaataaatcagctgatcaattagaattagatgaacattatcttccacgtattggttgttatgatactcgtaatagtgttgcaaaaccatctgaatttgatgcttcatttttcaattgtttaccagatgaagcagttgccttagatccaagacatcgttggattttagaaactagttgggaagctttagaaaatgctggaattgcaccaaattcattaaaaaagactacaacaggtgttttcattggtattaacaatgagcatgagcatgaagatttattacatgattgtggtattatccccccattagcttcacatgctactgcacaaagtagtattgctggtcgtttaagttacttttatcaattatttggaccttcatatactattgatactgcatgttctaccggtagttctgcactccattctgcctgccagtcattacaatgtaatgattgtaatttatcaattgtaactggtgtaaaatatatgtattcttctaaggaattccataaaacatgctcagctcgtatgacatcaccaaatggtcgttgtgctacctttgatgctagcgctgatggatttgcccaaagtgaaggttgtgtcacatttatattaaagcgttttgatgatgctgttcgtgataatgataatatcttagctgttgttcttggttc

SEQ ID NO: 27272 - DNA, 495 bp, Piromyces finnis
  Thiolase-like_subgr
tcaaagtggcctaagacaatctattagcgctccttcctccgaaggtcaggctatcaacatgcgtaaagctatggaatttgctggtattaaacccgaagacgtttcttatattgaggctcatggtactggtactccattaggtgatgctttagaagtacatgctttgaacgaaatttatgctggaagtcatacagaagaaaatcctctcgttgttggtagtattaaaacaaatattggtcatacttgcgaaactgctggtttagctggcatcgctaaagtcattgtttctatgcaacacaaatatattccaaagaatcttcactttaatactttaaatccagaaatagatgttaaattaattccaatgaaaatcccaactaaaaatctaccttggaattcttctgatccaaataaaccacttatcgctcaagtctcttcttatggtcttcaaggtagtatcattcatgttttcttagaagaatacattccaaaaaa

SEQ ID NO: 27273 - DNA, 507 bp, Piromyces finnis
  Thiolase-like_subgr
agaaacaagttgggaagccttagaaaacgcaaatattgctcctaattctttagaaaactcatctactggtgttttcgtcggaattaacgatgatcatgaatactcggatttaatgactgaatgtggtattgaaacatcaatcgctagtcatggttcaagtccaagtggtatcgctggtcgtttaagttatttctatcgtttatacggcccttctttcacaattgatactgcttgctcaacaggtgctaccgcacttcacactgcttgccgttcattacaacatcatgattgtaacttatctatcgtttctggtgtcaaatatatgtattcttcaaagaacttttataaaacatgtgctgccagaatgacttcaccacatggtcgttgtgctactttcgacaaagatgctgacggtttcgttcctagcgaaggttgcgtcacttttattttaaagcgtttagacgatgctatccgtgataacgataacattctttctgtcattttaag

SEQ ID NO: 27274 - DNA, 301 bp, Piromyces finnis
  Thiolase-like_subgr
cggtatgggtcttcgtttacctggcgctattaacaatgctaaatctttatggatgtctttagctaaaggaaaggattgtgttttaccacctcttaaaaacagagacttacatcgtaattacgttaataaaccaagtgaattgttagatccatcagaacataatatccctcgtttaggtctctacgatactagatcaaatgttgcaaaaccatctcaatttgatgctgctttcttcaactgcttacctgacgaggctttatctctcgatccaaggcaccgttggatcttagaaacaagttgg

SEQ ID NO: 27275 - DNA, 762 bp, Piromyces finnis
  Thiolase-like_subgr
cgttggtatcattggattagctacctacattccaagtagtactgttaatatgaccaaattagaagcgcatgataattgtcaaggtaaatatactattagtttaggacaaaagtacatgtcattaactgcaccaaatgaagatgttgtatccatggctttaaatgctgttaaacgtttaatgaagaagatgaacttaaagccaagtgatattggtagaattcaaattggtactgaaacaccagttgatttaagtaagagtgtcaagacctttattgttgaacaattctttgaacaaggaattactgacattgaaggtgttgataatgttaatgcttgcttcggttctactgctgccttattcgatactgtagcttggatgcaaagtgacttctggaatggtagatatgctattgttgtaggtactgatatttctcaaggtgaggatatttatcacttccttactggttcatcagccgttgcattattaattggtccaaacgctaatttagttgttgagccagaacgtggtattttcagtaatagtacttttgacttttataagccatatggttacaaaaaccattacccagtagttgatggtaaatactctatagattgttacctttcttccttaaagagttgttatgaacaacttaagaagaagactggttctgaaaccgaattccttgatcatcaatttagtgttttccataattcaagtgttagtttaactagaaagggtttcaatactttaattgaaca

SEQ ID NO: 27276 - DNA, 469 bp, Piromyces finnis
  Thiolase-like_subgr
tggtactaatgaagatggtcgtactttatctattactctgccatcttcagatgcccaatgtgccttaatgcaatgggtttgtgaaaagagtaatatcaaggctgataccattgattacgttgaagcccatggcactggtactccaactggtgatccaattgaagctagatctatcggtaatgcatttggtaaaaaggttcgttctccaaatagtaaaccacttccagttggtactgttaaaggtaatgttggtcatggtgaattcttaagtggcgctattggtttattaaaggtttctttaatgcttttcaacagacaattggttccaactgccgcttttgaaaagttaaatccaaaaattgatgttgatggtttgggtattcgtgttgctgataaaaatgaaccattagtcaagattaatggtaagattaatactccattccgtgctgctgttaactcttttggtttt

SEQ ID NO: 27277 - DNA, 777 bp, Piromyces finnis
  Thiolase-like_subgr
cgctattattggtgttggctgtcgtttaccaggtgatatatcaacaaaagaagacttttggaacatgttagttaccaaacgtgttgttacttcagaaattccatcagatcgttgggaccgtgaggaatggttcagtgaagatcctgttccaggtaccatacaaactaagtgtggtggtttcattaccaatgcttatgattttgataacaaatatttctctatttctcaagctgaagcttttgaaattactccagaacaacgttggttatgtgaacttgccgttgaaactatggaagatgctaatattcgcccagaagaattaaaaggaagtcaaactggtgtctttgttggttcagcaggtattgattttggtggtacacaattagctaatactcttcaaatgtctgctcatactatgactggtttagaaccatccattttctctaatcgtatttcttacatttttgatttacatggtccatcaattactagtaatactgcttgttctgcctctatgtcatctttatctatggcttgtaatgctattgctgttggtgattgtgacaaggcttttgttgctggttcaaactttttaccaactccaggtggttttgttgccttctctcaacttagagtcgtttctaaaaccggttcttgtaagccatttgatgaaaaggctgatggttatgctagacttgaaggtgcttgtatgcttttaattaaggattatgaaaaggctgttagagataatgataagatttatgccactattattag

SEQ ID NO: 27278 - DNA, 363 bp, Piromyces finnis
  Thiolase-like_subgr
tggtacaccattaggtgatgctattgagactgaaacattaaataaagcttttggtggtagtcatactgaaaagaaaccattagttgttggtagtgtcaaaacaaatattggtcacaccgaagaagtatcaggtttagccggtttaactaaggttattttatccatgtctcaccgtattattccaccacatcttcatttaaatactttaaatccaaaaattgatctttctgttattccaatgtctattccacaaaagaagagtatttggaagtgtccacgtggtaaaaagagaattggtcttgtttcttcctttggtttacaaggtagtgttgctaatgctgttattgaagaattcaagcaacc

SEQ ID NO: 27279 - DNA, 363 bp, Piromyces finnis; identical to SEQ ID NO: 27278
  Thiolase-like_subgr

SEQ ID NO: 27280 - DNA, 718 bp, Piromyces finnis; identical to SEQ ID NO: 27182
  Thiolase-like_subgr

SEQ ID NO: 27281 - DNA, 151 bp, Piromyces finnis
  Thiolase-like_subgr
ttctacttctcaatctggttctagaccatctatttcttctccagctatcattccacaagttatgaatatcaaaaatgctttacaaattgcaaatgttactccagaagaagttgattatgttgaagcacacggtactggtacaccattaggt

SEQ ID NO: 27282 - DNA, 129 bp, Piromyces finnis
  Thiolase-like_subgr
tcgttgtgctacctttgatgcttccgctgatggttatgctccaggtgaaggttgtatcagtcttgttcttaagcgtttagatgacgctcttactaaccatgatcgtatttatggtgttatcactggtat

SEQ ID NO: 27283 - DNA, 252 bp, Piromyces finnis
  Thiolase-like_subgr
tgttggtcatggtgaatacttaagtggaattattggtttaattaagagtaccttaattcttcataaaaatatgattgttccacaaacagcatttgatacccttaatccaaagattgaatgtgaaaaattaggtattcgtattgctaataagatagaaaaatttccaggtcaaggacgtcatagagttgctgttaactctttcggttttggtggtgctaatgcaaatgctattatagaagaggaaccccaatt

SEQ ID NO: 27284 - DNA, 777 bp, Piromyces finnis
  Thiolase-like_subgr
tgctattattggtacaggtattcgtttaccaggtgatattaataataaggatgatttctggaaggtaatgatagagaaaaaagtaattactggtcttactccagaagatcgttgggatcgtgatgaatggtattgtaagacagaaaagcccggaacaattcaaactttatatggtggttttatcgagaatgcttttgattttgataataaattcttttctatttcccaaaaagaagcattagatgctactccggaacaaagatggctttgtgaattaactgttgaaaccattgaagatgccaatattaatattgataaatttaaaggaagtaatactggtgtttttgttggtacttcaggtatagattatggtagttacgttttttcagtaccagaaaaaattacaaaatatacttatagtggaattgaaccttctattcatgccaatcgtgtttcttatcttttcgatcttcacggtccatcattatccaccaataccgcttgctcttcttcattgactgctttatccattgcttgtaattctatggccgctggtgattgtgaaatggctattgtcgctggtactaatttcttccaagctccagcaaatggtgttgcctattctcaacttcgtgttgtatcaaagaaaggcgcttgtcgtccattcgatagtggtgctgatggttatgctcgtttagaaggtgctggtatggttttattaaaaccttatgaaaaggccatccgagataataataaaatttatgctactattttaag

SEQ ID NO: 27285 - DNA, 258 bp, Piromyces finnis
  Thiolase-like_subgr
tgcttgtaatgaagatggaaaaactgcttctttaactactccatcttccaaagcccaatataaattaatgaagcgtgtttatgaaaagggtcatattgatccatgtactattgattttattgaagctcatggtactggtactgctgttggtgatccaattgaggctagttccattggtgaagcttatggtaaaattaataaagccaatggaaatccagccatcccagtcggatccgttaaaggtaatgttggtcatgg

SEQ ID NO: 27286 - DNA, 801 bp, Piromyces finnis
  Thiolase-like_subgr
agaagctgaacaattcaagaagaagcatggtgatcgtgttgacatttatgaaaatgctgaatctggccaatggactgttaagattaagaagggttcttccatttacattccaaaggctcttcaattcgatagaactgttgctgctcaaattccaactggttggaagccagaaacttatggtgttccaaagagtattattgaccaagttgatccaataaccctttatgttattgtagctactgttgaagctttaattagttccggtattactgatccatatgaattctatgaatatgtacatgtctctgaagtcggaaactgttctggtggtggtgttggtggtatgacctctaatcataagcaatactttgatcgtgtatttgaaaaaccagttcaaagtgatattcttcaagaatgtttcattaacactatgccagcttggattaacttattattactttcttcttctggtccaattaagactccagttggtgcttgtgctactgctgtcgaatctgttgaaattggtttagaaaccattttaagtggtaaggctaaaattgttattgttggtggttatgatgacttccaagaagaaggttcatacgaattcgctcaaatgaaggctacaagtaattccttggaagaacttgctcatggtcgtgatccatcagaaatgtctcgtccagctactactacaagagctggtttcatggaagctcaaggtgctggtcatgaaattttaatgactgctagtcttgctattaagatgggtgttccaatctatggtattattgctca

SEQ ID NO: 27287 - DNA, 390 bp, Piromyces finnis
  Thiolase-like_subgr
aagaggtgctcttgctgtctttggtttaactattgatgatattcaagccttatccttccatggtactagtactaaggctaacgattctaatgaatctgaagtattcaacaagcaattcaagcaccttggacgtactaagggtaatgcttgcccagttattactcaaaagtacttaactggtcatccaaagggtgctgctgcttcttggatgcttaatggtatgcttcaagttattgaaactggtattattccaggtaatcgtaatgctgataatattgatgaaaagcttcgtaagttcgaatacctcttctacccatctcgttctattcacactgatggtgtcaaggctggtttattgaagtccttcggttttggtcaagttggtggtga

SEQ ID NO: 27288 - DNA, 381 bp, Piromyces finnis
  Thiolase-like_subgr
acgtggtgctttagctgcctttggtcttactgttgatgatattggtgttgcttccttccacggtactggtactaaggccaatgataagaatgaatctgatgtattcaacaagcaattcgaacatcttggtcgtactaagggtaacgcttgtccagtagtttgtcaaaagtatcttactggtcacggtaagggtgctgctgctgcttggatgttaaatggtgttatccaaattcttcaaactggtattgttccaggtaaccgtaatgctgataacattgatccacttcttgaaaagtatgaacatctttggttcaataacaagactttcaagactccaggtgttaaggctggtttattaaagtcattcggtttcggtcaagt

SEQ ID NO: 27289 - DNA, 801 bp, Piromyces finnis; identical to SEQ ID NO: 27286
  Thiolase-like_subgr

SEQ ID NO: 27290 - DNA, 390 bp, Piromyces finnis; identical to SEQ ID NO: 27287
  Thiolase-like_subgr

SEQ ID NO: 27291 - DNA, 801 bp, Piromyces finnis; identical to SEQ ID NO: 27286
  Thiolase-like_subgr

SEQ ID NO: 27292 - DNA, 801 bp, Piromyces finnis; identical to SEQ ID NO: 27286
  Thiolase-like_subgr

SEQ ID NO: 27293 - DNA, 381 bp, Piromyces finnis; identical to SEQ ID NO: 27288
  Thiolase-like_subgr

SEQ ID NO: 27294 - DNA, 504 bp, Piromyces finnis
  Thiolase-like_subgr
tggtagtaatgaagacggtcgttccccatctcttactatgccttcctatgaagcacaatataagttattaactcatgtttgtgagaaatctggtattaatccaactcaaattgattatgttgaagcccatggtactggtacaaaggttggtgatccaattgaatcccatgctataggtgatgcttatggtagaggtaagggtattcgtggtccaaatgacccacctgtattagttagttctgtaaagggtaatacaggtcatggtgaaaattctagtggtattgtaagcattattaagacttcaatgatgctttataaacgtaaattagtaccaacggccgcctatcatcgtcttaatcaagctattgatgccgaaaaattaggtattaaagtttgtgaaaaattagaagattggaatacccctcatatcttacatgctgcagtaaactcatttggttttggtggtgccaacacaaatgctttattagaagaagttaaacattt

SEQ ID NO: 27295 - DNA, 780 bp, Piromyces finnis
  Thiolase-like_subgr
tgctgtcattggtattggttgtcatttcccagaaggtattgaatcaaaggaatccttctggaaaatgttggaagatggtaaatgcattaccaaagatattccaaaggaaagatgggataaagatgaatggtattctaaagaacctgttcaaggaaccattcaaaccaaacgtggtgccttcttagagaatccatatcttttcgataacaaatatttttacatctccatgccagaagctaaggaaatgtcaccagaacaacgctggctcttagagttaaccgttgaaactcttgaagatgcaaatatcaaaccagaaactttaaagggttctcgtactggtgtttttattggatcatcaggtattgattacttagttacccaaatttctcatgctaatgatattaattcacacagtcctactggttttgagctttccattttagccaatcgtttgtcttatgtctttgatttccaaggaccatctataagttgtaatactgcatgttcatcagcattctctgctttaaacatcggtttaaatgctatgattactgatgattgtgaaatggctattgttgctggttcaaactttatgagttgcccaggtagttttgtagcttattctcaacttcgtgttgtttctaaagatggttcatgtaaaccatttgatgaaaaagctgatggttatgcaaagttagaaggtgctggtatgatattagttaaaccttatgagaaagctgttcgtgatggtgataagatttattgtgcaattgttggttg

SEQ ID NO: 27296 - DNA, 777 bp, Piromyces finnis
  Thiolase-like_subgr
tgtcattggtgttggttgtcgtttcccaggtaatattaaatcaaaggaagatttctgggaaatgcttactactggaagatgtcttacctctgaaactccaaaggaccgttgggattctgctgaatggtataacaaagagccaaagagaggtactgttcaaactactagaggtgcatttatggaagatgccttctactttgataataagtatttctcaatttctcaaaatgaagctaaggaaatgtcaccagaacaacgctggttattagaattagctgttgaaacctttgaagatgctaacattaatccaaagaaattaaagggttctagaactggtgtctttgtcggttcttccggtatggatttcgtagcagctcaaatttctcatgctaatgatttaactcaacactctgctactggtcttgaactttctattcttgccaaccgtatctcatactactttgatttaaatggtccatctatttgtactaacactgcatgctctgcttctatgactgccttaaatcttgctattaattccatgattactgatgattgtgatgcagctcttattgctggtactaatttattattcactccaggtagttgtgttgcatactctcaacttcgtgttgtctctgttgatggttcttgcaaaccatttgataagagggctgatggttattctcgtgttgaaggtgctggtatgttattgattaagccatatgaaaaggctgtaagagatggtgataaaatttattgtgctattttaggtag

SEQ ID NO: 27297 - DNA, 549 bp, Piromyces finnis
  Thiolase-like_subgr
tagtactaatgaagatggtcataccccatctctcactatgccatcctatgattctcaatgtaaattattaactcatgtttgtgaaaaattcgacattgatccagcctcaattgattatgttgaagctcacggtactggtactgcagttggtgatccaattgaagctcgttcaataggttatgcctatggacgcagagttcgtgaaggtaaacaaattaagactactcgcccaggtgagactgaggaaattcttgatcaaccaacctatccattgatcattggatctagtaagggtaatactggtcatggtgaatattctagtggtattattggtatgattaaggctgttttaatgcttcaccatcgtactatggttccaactattgctcatgaggaaatgaacccagccattgatgctgaaggtttaggtattaaggttgctacaaagttagaaccatggactactccgcacactttacgtattgctgttaactcttttggttttggtggttcaaatggtaatgccatttttgaagaagttgttaatga

SEQ ID NO: 27298 - DNA, 495 bp, Piromyces finnis
  Thiolase-like_subgr
tagtagtggtcaaagtggtttccgtcaatccattagtgttccttcatcagaaggtcaagctcgtaatattgaacgtgctatggcagttgctggtgttcaaccttctgacatatcttacattgaagcacatggtactggtacaccatatggggatgccattgaaattcaaggtattaatcaagtttatgctggaagccacacctcggaacatccattagtcatcggtagtatcaagacaaatattggacatacagctgaaactgctggtttagctagcattgccaaggttttattagctatgaagaataaaactattccaagaaatcttcatttcaagaaccttaatcctgaaattgacttgggagttgttccactctccgtcccaacacataatgtgaaatgggaaactgttgatggtaaaccaagaacagctttggtatcttcttatggtttacaaggtagtgctgttaatattattctacaagaatacgttcc

SEQ ID NO: 27299 - DNA, 795 bp, Piromyces finnis
  Thiolase-like_subgr
tatgggtttacgtcttccaggtgctatcaatagtgacaagtctttatggtctactttagttaaaggcagagactgtattacagctattccaaaggatagaaaattacatgaaaactatgttgataagcaaagtagtgaattaaacatgggtgaacataatgttaagcgttgtggctactatgactcccgttcaagtggtaaaaagatttctcaattcgatgcagaatttttcaattgccttccggatgaagctattggtcttgatccaaagcatcgttggatcttagaaacaagttgggaagctcttgaaaatgctggtatttcacctgaatcccttgaaaataccgatacaggtgtttttgttggtattggtgatcaacaagaacatgtcaagtttatgcaagaatgtcaaaaggaaaaagttgttgcccatcacaatagtaatccatcagctattgctggacgtttaagttacttttacaaactttatggtccatctgttactgttgatacagcttgttccactggtgcaacagctcttcatactgcctgtcgttctatgattttcggtgattgtaacctttccattgtgaccgcctccaaattcttattctattcagaagaatttgaaatgacaagtaaggcaagaatgacttctccatctggtcgttgtgctacttttgataagaatgctgatggttatgtcccagctgaaggttgtgtaacctttatattaaaacgtttagaagatgctgaacgtgataaggatcatattcttggtgtaattcttggtac

SEQ ID NO: 27300 - DNA, 345 bp, Piromyces finnis
  Thioredoxin-like
tactcgtgattctttggtcgtttactataaaatagattgtccattttcacaggagcttttaaaaaccctagaaaaattgggtaaaaagtatgctaattatcgtacaaaatttagtattgtaaagtatgaagctgaagatcaaaaaattccaaaaatgtctttatggagaaatttagaaggatatccaactattgttttatataaagccaatccattttctcgtgaaaaaaagtattactatgtttatccagaaaatgccggaagaagttctgtttcgttagatcgctggattcaaactcattctttttataagccaaagattatatttaatgaagaagattataa

SEQ ID NO: 27301 - DNA, 309 bp, Piromyces finnis
  Thioredoxin-like_fold
tcctactcgtgattctttggtcgtttactataaaatagattgtccattttcacaggagcttttaaaaaccctagaaaaattgggtaaaaagtatgctaattatcgtacaaaatttagtattgtaaagtatgaagctgaagatcaaaaaattccaaaaatgtctttatggagaaatttagaaggatatccaactattgttttatataaagccaatccattttctcgtgaaaaaaagtattactatgtttatccagaaaatgccggaagaagttctgtttcgttagatcgctggattcaaactcattcttt

SEQ ID NO: 27302 - DNA, 372 bp, Neocallimastix californiae
  TIGR00556
taatggaattggtgttgatattgaattagttaccgaggttccaattaccaatgaaaacttccttgaaagaaatttcactaaggaagaaattaagtactgtatgagtagaccagatccacaatctagctttgctggtagatggagtgctaaggaagctgttattaaggcagtatcttctcgtgctacttctaaggtttggactaaaggtgaagctgccccacttattgatattgaaattttacctggtgaatcaggtgccccagtggttaaattttataatgatgctgaaaaagctgttaaagatgctggtattaacaatgttaaagttactatttctcattctggtggtttctcttgtgctatggctatggc

SEQ ID NO: 27303 - DNA, 360 bp, Neocallimastix californiae
  TIGR00556
tattggtgttgatattgaattagttactgaaattccaattaataatgaaaatttcattgaaaggaactttacaaaggaagaaattaaatattgtatgagtagaccagatccacaatctagttttgctggtagatggagtgctaaggaagctgttgttaaggctgtttcttctcattcctcctctaaagtttggactaaaggtgaagctgccccactcattgatattgaaatcttaccaggtgaatcaggtgctcctgttgtccaatttcataatgatgctgaaaaagctgttaaagaagccggtgttaaaagtgttaatgttactatttctcattctggtggtttctcttgtgctatggc

SEQ ID NO: 27304 - DNA, 366 bp, Anaeromyces robustus
  TIGR00556
tggtgttggtatagatattgctcttatctctgaattaaatgttgataatgaaggatttattgaacgtaatttcactaataatgaaattcaatattgtgaagctaaaccagatagacgttctagttttgctggtaaatgggccgctaaagaagctgttataaaggctatttcttcttattccttagaagctcaaaaaatatgggaaggtgctggtgctccattaaaggatattgaagttgttattgctgaatctggagctccaaaagttcttttaagtccaactttaaatgaaaaggttaaatctgttggtgttaatgatgttaaggttactattagtcattccggtcaatttgctgttgctatggc

SEQ ID NO: 27305 - DNA, 369 bp, Anaeromyces robustus
  TIGR00556
tggtattggtgttgatgttgaattagttagtgaaattccaattactaatgaaactttcttagaaagaaatttcacaaaggatgaaattacttattgtatgagtagaccagatccacaatctagttttgctggtagatggtctgctaaggaagctgttataaaggctgtttcttctcgtgctacttcaaaagtttggactaaaggtgaagctgccccacttgtagatattgaaattttaccaggtgaatcaggtgccccagttgttaaattccataatgatgctgaaaaggctgttaaagatgccggtattaaagatgttaaagttaccatttctcattctggtggtttctcttgtgctatggctattgc

SEQ ID NO: 27306 - DNA, 372 bp, Piromyces finnis
  TIGR00556
taatggtattggtgttgatgttgaattagtaactgaaattccaatttccaatcaaaatttccttgaaagaaactttactccaaaggaaattgaatactgtatgagtagaccagacccacaatctagctttgctggtagatggtccgctaaggaagctgttatcaaggctgtttcttctcgttccacttctaaggtttggactaaaggtgaagccgcaccattagtagatattgaaattttaccaggtgaatccggtgctccagttgttgaattccatggagatgctgaaaaggctgttaaagaagctggaattaatagtgtaaaagtaactatttctcattctggtggtttctcttgcgctatggctatggc

SEQ ID NO: 27307 - DNA, 363 bp, Piromyces finnis; identical to SEQ ID NO: 14382
  TIGR00556

SEQ ID NO: 27308 - DNA, 372 bp, Piromyces finnis; identical to SEQ ID NO: 27306
  TIGR00556

SEQ ID NO: 27309 - DNA, 363 bp, Piromyces finnis; identical to SEQ ID NO: 14382
  TIGR00556

SEQ ID NO: 27310 - DNA, 1239 bp, Anaeromyces robustus
  TIGR01733
atttaagaaattagacgaaatgagtaattctttagcacattatttaagaaaagaaaatattggtagaggagatattgttccaatcattagtgaacgttctcattactttgtaattgctacattagctataatgaaatctggtgcagcatttttaccaatagatccagacttcccaaaagaacgtattgaatatatgattaatgaagttaacgctaaatttattctaaaatatattacaaatattgaaacagaacgtaaaattaaatttgacaatgttattgaatatgaattacaaaaacataattataaagataatgttttcgaaattactaatattaataacagtgatgatttatgttatgtattatttacttctggtactacaggtaaaccaaaaggaactatgatgacacataacaatttaattaattattctctttacagtcaaacatataatggaaaagaaatatatacaaatgattttaataatgctttatctgcagctaaatttacttttgatatgtcactttgtgaaatattatatcctttaattaaaggaaaatgtgtattcatatgtgacgataatgaatataataatcctcaattaataggagaaaaaatattaaaatataatatagattatatatttagtacaccttcaagaattgaaaactatatgaaaaataaaacatacatgaaagctttaaagaatttaaagtgcattttaattggtggagagggttgtaatattaaaacagttgaaaatataattaaaaatacaaatgcaaatatatataatctttatggtccaactgaaacaaccattatgtgtactgtatcagaactctcaaatttgtataaacaaaacaaattaaatgttattactattggtaagccattatgtaattgtaaattgtacatcttagatgaatatttaaaaccagttccgattggagttgaaggtgaaatatatattggaggatatggtgttggtaaaggatatcttaatcgtgaacaattaactagagaaaaattcgttgattgtccatttaatatcaaaaatggtttaccaaatcaaatgtatagtactggtgatttaggaaaatggacagaaaaaggtgaaataatttgttctggacgtgctgatttccaagtaaaaattcgtggtcaaagaatagaattaacagaaatagaaaatactattaaaaaaattaaaggaattaaatattcaattgtaat

SEQ ID NO: 27311 - DNA, 1227 bp, Anaeromyces robustus
  TIGR01833
tgaaaatattggtattattggtttagcaacttatattccagcaacaactgttagtatgacaaaattagaagctcatgataaatgtcaaggtaaatatactattagtttaggccaaaagtatatgtcattaactgctccaaatgaagatgttgtatctatggccttaaatgctgttaaacgtttaatgaaaaaaatgaatttaaaaccaagtgatattggtagaattcaaattggtactgaaacaccagtagatttaagtaaaagtgttaaaacatttattgtagagcaattctttgaacaaggtattactgatattgaaggtgttgataatgttaatgcttgttttggttctactgctgctttatttgatactgttgcttggatgcaaagtgatttctggaatggtagatatgctattgttgttggtacagatatttctcaaggtgaagatatttatcacttccttacaggttcatcagctgttgctgttttaattggtccaaatgctaatttagttgttgaaccaaatcgtggtattttcagtaatagtacttttgatttctataagccatatggttataaaaatcattatccagtggttgatggtaaatattctattgattgttatcttaattctttagttagttgttatgaagatcttaaaaagaaatctaaatctgaaacagaattccttgatcatcaatttggtgttttccataattctagtgttagtttaacaagaaaaggtttcaatactttaattgaaaaggaaatttcaaaagttcttccaaatgctgaaccacatgaaaagagacaatttatatcgaaaatttataaagaaagagttgaagcttctactttaatgactgctaatatgggttgtatgtataatgcttcagttcttaatggtattatttcattaaatgaatccttaaaaccagaagatattggtaaacgtattttagtttattcatttggttcaggttctgttggtgctctttggtcattacgtattgacggtttagctgaaaaggatgatttaaataatagattaaataatcgtaaagaaatttcagttgattcttactttaaggtaagacaattatggcttgaagatattaagaagtttggtcgttcttataagaaagatcaatttgaacttccaatacgtgatggtgattattatttatcaagtgtatctgtcaatggcgttcgtaaatatgaaat

SEQ ID NO: 27312 - DNA, 1227 bp, Piromyces finnis
  TIGR01833
tgaaaacgttggtatcattggattagctacctacattccaagtagtactgttaatatgaccaaattagaagcgcatgataattgtcaaggtaaatatactattagtttaggacaaaagtacatgtcattaactgcaccaaatgaagatgttgtatccatggctttaaatgctgttaaacgtttaatgaagaagatgaacttaaagccaagtgatattggtagaattcaaattggtactgaaacaccagttgatttaagtaagagtgtcaagacctttattgttgaacaattctttgaacaaggaattactgacattgaaggtgttgataatgttaatgcttgcttcggttctactgctgccttattcgatactgtagcttggatgcaaagtgacttctggaatggtagatatgctattgttgtaggtactgatatttctcaaggtgaggatatttatcacttccttactggttcatcagccgttgcattattaattggtccaaacgctaatttagttgttgagccagaacgtggtattttcagtaatagtacttttgacttttataagccatatggttacaaaaaccattacccagtagttgatggtaaatactctatagattgttacctttcttccttaaagagttgttatgaacaacttaagaagaagactggttctgaaaccgaattccttgatcatcaatttagtgttttccataattcaagtgttagtttaactagaaagggtttcaatactttaattgaacaagaaatttccaaagtacttccaaatgccaagataattgaaaagagaaaattcatttcaaatgtttacaaagaaagagttgaagcctctactttaatgacagctaatatgggttgtatgtacaatgcttctgttcttaatggtattatttccttaaatgaatctttaaccccagaagatattggcaaacgtgttttggtttactctttcggttcaggatctgttggtgctctttggactttacgtattgatggcttagctgaaaaggatgatttagttaatagattgaatagtcgtaatgaagtttcagtagatacatactttgaaattagaaaattatggcttgaagagattaaaaagtttggacgttcatacaagaaggatcaatttgaacttcaaatccgtgaaggtgattattatttatcaagtgtttcccttgatggtgtacgtaaatatgaaat

SEQ ID NO: 27313 - DNA, 1041 bp, Neocallimastix californiae; identical to SEQ ID NO: 14517
  TRANS-2-ENOYL-COA REDUCTASE, MITOCHONDRIAL

SEQ ID NO: 27314 - DNA, 1041 bp, Anaeromyces robustus; identical to SEQ ID NO: 14520
  TRANS-2-ENOYL-COA REDUCTASE, MITOCHONDRIAL

SEQ ID NO: 27315 - DNA, 1041 bp, Anaeromyces robustus; identical to SEQ ID NO: 14521
  TRANS-2-ENOYL-COA REDUCTASE, MITOCHONDRIAL

SEQ ID NO: 27316 - DNA, 1038 bp, Piromyces finnis; identical to SEQ ID NO: 14524
  TRANS-2-ENOYL-COA REDUCTASE, MITOCHONDRIAL

SEQ ID NO: 27317 - DNA, 555 bp, Piromyces finnis; identical to SEQ ID NO: 13818
  UNCHARACTERIZED

SEQ ID NO: 27318 - DNA, 582 bp, Piromyces finnis; identical to SEQ ID NO: 13819
  UNCHARACTERIZED

SEQ ID NO: 27319 - DNA, 207 bp, Neocallimastix californiae
  VCBS
tttagatggtgatggtacctatgatttcgttgtgaagcgtatgtcagataatcgtgatcctattcttcttgaagcttataaattagatggtaccttcttatggcgtattaatctcggtccaaatattgaaacttacacttcctctctcactagtcctgtcttggtttacgattttgatggggatggtaaggctgaagttatggttaa

SEQ ID NO: 27320 - DNA, 705 bp, Neocallimastix californiae
  ZINC FINGER FYVE DOMAIN CONTAINING PROTEIN
gaatatgtggaattttgctattagtggtgctgttgttgacgcaaaagttgttgatggtaatcctcaatatactccaatgactgaacaatataattggttccttaaaaatatggctcctggaaagcaatttagtaattggaaaggtgaatcttctttatttgctatttggtttggtattaatgatattggtagtaaaagacgtaatgaaggtttaactagttctcaaattgatgagaaaattgccacttctatgtttaatatgattgatggtatgtataaacaaggagctagaaacttcatgttcatctttgttcctacaatagaaaaatgtccagcttattctaatggtaataatccaaatatcaaatctgatataccaaattataatagtaatcttaataaatatgcaaaaaatttccaagcttctcatccagatactaatgtctttgtttatgattcctacaatgaatttgattacattatggaaaataagtcacaatatggtattactaacattgatagtacttgtggtggtggatttggttttggttggggttggggcaatcaaaataattgtgattccaacacttacttctggaaggatgtcattcacccaactccaactgttcacaagccattagctcaagatattgaagatttcttaattgaaaatgaaaaggccagccaacaaattttcagcaaagg

SEQ ID NO: 27321 - DNA, 705 bp, Neocallimastix californiae; identical to SEQ ID NO: 27320
  ZINC FINGER FYVE DOMAIN-CONTAINING PROTEIN 26

SEQ ID NO: 27322 - DNA, 327 bp, Neocallimastix californiae; identical to SEQ ID NO: 14721
  ZINC FINGER-CONTAINING PROTEIN

SEQ ID NO: 27323 - DNA, 3534 bp, Neocallimastix californiae; identical to SEQ ID NO: 13996
  ZINC FINGER-CONTAINING PROTEIN

SEQ ID NO: 27324 - DNA, 2613 bp, Neocallimastix californiae; identical to SEQ ID NO: 14722
  ZINC FINGER-CONTAINING PROTEIN

SEQ ID NO: 27325 - protein, 5633 aa, Piromyces finnis
  ScaA scaffoldin- Protein Sequence
MVNFKRFGSLLPLLLGISKVLGADEVVEQEGSTGNSNTPKPIEYNFNDGQLYIKDGVTESPYKNPLPGYYKYKDIEGTDNYVKCDRYEKCEDITSSLLTKSICKVNGELIINSRSENKVGICLENKAYTFVEFGENDKNYVVSQNVELFGFDAKTTHVLLKISTNSITFDNTAKDFEDQCVLKGDNNGYIVDRKVDFCSTDSTDMYYTCKSGKCTTKKQDDYEDVETEYTKEKCTFIIDEGTVNNSCTKKGYYLHVDGQSKKLIECLVTQAAPLTGRSGEISCGIKTTTGITGYYWNELQYNEIIKCVDGDCSLVTFEDECQKAGDFIDNGYNVKLCNTASTAFVFKGIEDKLIEDKKENNYIDNIFGEENIRYVVDTNDYKVEIKKEHDIKDTILENKHYICSNGKCKKTDISINSSLDCKYTNAKLITEQKYFITADGQFIQDTDSDKDKYSGYLISIKETKCNVISKSNGYYVFSESQLVFCNTEQGCKLDNSVLLVAKPTDYPIYLLNSDNTDSTKLIRCTSSSECKVYKGEKGYYLDGSVDSKELSLIYCNGSTCSATMVASRRAYYTKDINGEVTTEGIILCNNGCVKATLGTEEKYYLNGGVGSNVTPLIHFKSGADPEIEVIDSSKKELYKNANDVKGFIYCSSPTECSEISKFQDKEYVDVKEKKIHYYDDEKEKWSESDINLETNGDSNAYYVNKLTNEILTNNNEDGKLVVCSKASDVTTCGIVTKEFKTYYINGGDDSKSLIQYDKSKTKFSLMKNVDEGYYINSNTDVISCNENCENFSIPENCDVNEGKIIKSSNTNKFCISTSKSVELTTKEEKYMVGSDSDSKIYKVNNKNVLVDKSEGYYLIKRDDTKKFVSAKDIAGDVYYCNGVKCVKQTISDEKYLPNDDENTNSNLTKIYCNGGQCKLNAKSATENYCIKTNDGNTDKSLYVCKDACDFTAQNNCSNENNKIGYYLGYYNSYLIKCSDNGNCEKEILDDSAIGYYLNMDNSKPLIQCYTSLGKTNCAAVSEVKNGYYTTPESTTDGNIIKCNNGKCKLETVTVTAQEIKYFVSGETNKHITKCEEVVEQEPEPLRRSGVEMVTKCTAIASPKLGWYVNGDKNAKTEGLDLILCSKTNGSFSCIEKPKNIGYYLSSEDNKLLNCDKTGCNDVVDLSESSANSYYVNGENNQLIYCQGPNCKSIDVNSKGFYLSATNQKYLIKCDKVDKNIVCTELTKPGTNGVYMNADTYTLSQQPLIVYNDDDYDDSKSKFKLSGNDIKNGWYKSAETDVLTKSPDNSVIKCTNSRNCSYVKVKDSQCSPSIAGEFSKVNGKLQWCKTDGSGFVDFVNGEVISEFNKNDKIPGVNLPSGVKKAYALLQVDTTFIVRSDAVDGYKYDKSLYFCPKEKYGICTEVSTADLVPGIYIDHKITNKEIKCSEVDKKVICEETENKFVTYSDGYKINNKDMYGINVDYMYAFANNGNSFPTTGDYFRANVNKYSIKLIKNIEGVEDITKYNNKFDSNGKLFVNKIKDSEGKLKENDENIDANYYDYDTNYGFYEYSKVNEAISLDKVVIYFNETEEFKYECKIGDVCIKKELTEVPLKGFKFDSDAGVLKPEFTSNKEERKIEFKVGTYIVGDREVTYDKDGNFKQGETIPNSDDADEGSICKDGGVVAFKVGGTKTIKSSKRVSKFVFKPESVNASKRSESDEAYGLMELTHLSCTVSKEIRNIFISGEDDDEEKDHIMITEEILDVDSAYSCNAKECKSITENEMTRYYINTAQQGKIKNAYAKCGYDDKKKKVVCVLLNIKEDDKLLFENAAATSAEDALISCNYKEGCKTMPVSGKLGLPLCEEKYDDIKLTYYVRVDNGEELEKDQYCIDEKEKIVSSSEFIESEIFVFDITYRQIDYSKIKENHKFASMYYKNENNGKYVQTYGYITSTDGYSKLTNEGLTFIKYKDTYKSCELEGTGSIIKEGSDVEICIGSEPPRKITGMDNTYNLLNINLNNVYPEVNAGNKILVKVKGDIVYSIYEDGYVLIDSDNKLVEMTVQTRKREVEPTPSLTLYQFNVNNMYCDSIENPSNGIYKTNMNEKTINCIGKKCNLKDIENLQFSKNITYSYIKDKNNLFSSVSTDEFIIEISEYKITPLIADNYILMDEKLYLCNSNKETCNEEDIKPGWYISGSESYKAIKCESGACKTVENLSSSCSKMGDLIYSTSAKTYQLCNTTRNGKSLVDAAGSIINLRNDNSNYDKIKSEFPEQNNIITISKNAAIGIGIDSGRNEATESIYKPIKTCYSIKSNVDETKQCQFSSSDLIAVGNYCIKNDQLYVTTEEKKCQKVDKNTALLLNGEIEIKSVADITLTTRMYYCNGEKCEITAGYMKLGNDEVKCDLTGCVKNESITHDFTDPITYSYSEDPSDFPGAANVKSALIETGSNYKVLFKGDGYYLINSSKEMLDKDSEENPNLSANATGNLYLCNKNDLSCVMQNDDDAQDKINGYFLNGKTKDNTSIIICKDGVCSIINNSNADNINDIHYGTDKCNSTISGSLVRDNKKNVKLCISNIAQSFTTNDSVKYYAIKLLKNNAFGSVRVTEENDVANIIVKVTSKSITQYKDKGYILHKSTNEIVENVGGNNSASLYNCKEDDDNRVVCDAVKNINNGWYFNEHYNDKRYIVCNSGACDVKEAPELMQCQSSGSLIYNDGKFKLCKTQNEQVDLVGNYKVIVNISGKEKFPSIEMNNTEILLEINNKNSVTIEKFEGYKIINEQDKKLIIDDDKEGLLYKCESTGECNRVLLPNQNYYLKNNATGFAEELIYCTGEYGSKCEIKNPEEGFYVGSDVNKPIIQCIQPGYEVDGSTTTTGNIVCKERQFKEGWFMNAGSDKNEYPLIYCNYERGCVTIKDLNDGWYINTGRESIFGYDGLNNSTIPSIIKCEGNSCDYVKSKDLKSACEENGGEIIISKGSIKLCKNNKESIDVSKASNTNIIMISENEKFPGQSGSDIIAVEINKFSAVQKKYAEETFLYINKEMYRCDDTCEIIKGNDETNGMKVLDQFTRNIYTSSLCDENSCSWVINKDEGLIFLDGNYKLVEGIGEGFNDISHLFKCKKFEKNPTCYELDFNEGYYINQYHKIDENKSGQKLYIYDGEWKIFDDEYKEKPTCTYLNYKQNYCTISYSDEVYSDSDNENIISAGEICKSSNGKYFIAYGEINTGIDSPNCVSFPNDATESYYKINENKYIMDKYGFFVVGDYVEKTNSKLVCNGMKCQIEKILRCSFNIQNGTCKSSSDIIKTGNICISEGNTYLALSDISTSEGSCIKYVSPSNEKTIPYSEYGYDNSKIVKGDNKNKYLLINNKLSIFNSQESVMLKSEGNYVIDNYNNLVNIGNNEISISENSIFKYILCDGNKCERRTTCLNKNEAEYIYDSNESIIKCDPLKKTIQKISQPGYYLNKPWNNLIKCHQNIVKSKIECKVINGNNGNEGYYINAGNKDKIIKCIRNEGRFSCSEENIVECTLDEKTNTCTSKLELLRNSYCIYRAEDKKLGKIEKLMYVENYIKEGEKGSCISGNDVDPYFYYSKQSKFLGHPERKDLIRVSGSSVTSIYENDIGYYVIDTKDGLGLKNDVGLEKSRFYECTKDGCIENVNPDVNKIYINKASSEKLIKYKGYWDVIIESKCTIYANNPKLCYLGGEGINNKGILYIENDGMLTFYVPTEISEKVNAINRNKFDTKDKELEKNRYIHYENNLYLLNSNSQSFDKQVKEGYYFFSSKKTKSFNLLPYVTTVNKTLEDENSNEISYYEVTKNCYGEINSSESKSINDLKKGCYWNRANENVVIQNMEISDKVKPEEEDEEGDKRRKRNNDVELNSVVKSNTNICKSVVKNNCVSAIEGQVISKGDVCLVKDGEFKGLYLIINDIKKGSSGTNCLRYDYGNVYHYVNEKTNINGKDYEKILVKIGKDEIVPFDTKLEDNSNVGYYVLNSNKQMISNESLESATAYNCNYKYDEENVNIEGFECNSFEEKGNKYYYGNYENILYASNRKWKVEKDEKYYFRNDENLASSYDEESQNEDTCKPIKLGNIEYNIEGYYLNSAELNRTVLVENKSEDYSIYKGLIKCKVLENGQCSSEEEGKQLVTGDICYDGSKKKLYVVEIEKSQDENTNDITKCYTGSRNLKYKIIDNVLYQLDGLSLKKMASGIYILNDKLEKFESEYPEKPYQIVSCENGGCEIKDKLQLESNEIVLNSAVVYEGSKESILKYYNETIGEGNEKFMNLKDNNKCYCLDKNGEIPNEDSDSCYYFVNCKTDSYNINYAINSNERMILKYESGYYKLNTGEYDNKKIKYDPKLDVIKHGNDYNIDENEIKYKIDNNNIFKLKPKYITYGYGIIDGLYLLKDGKPFESEEWTTLTEKEVCYAVKGSCNKSKLKTYRENKYVINKAVGKTSIVTYDLENNLWRTVKEDGYYFLFDHNGETYSINIEDRRPSKIYEIRNGELIEENLVNKEGEIGFYLFNDLIVEKVGMGWEDAKKILNNVDVVEKSNCNAIEKAEIIEADEYCYNENYGMCIVKSLIDDKTGKNSNCVFNTNASKHFEVINNELYLIDANSFRKITSSGIYVIGNDKLGYNGKKEGSASAYKCVDGKCTIANDLESQYYYNKASELLGEEVILYHDNARDSWRKTSESGKYVFNNKGYPTVSSEEGMKVYEVGKKGSKIEKVESASDGKLIVKTISNELFVIDVKNGKIELKRMKKCSVDVNGNVKVKGKLQVGDLCNADGNVVIITANKNAKREEVEDDEEVEYSYTGAVSDNQESKMIYIEEEMKFAELSNEGYEYLDIEGYVVLDKSNGGLLESTTEVLCDAYLCKDGKCTLLAADKIKSGNYYINSLSENGKLVKYVSNGKWKVESEIGYYFLTSDMKMVEKEGVPEYVIDVRKVNGKMEQVEITDENVVGFYLNKAGKNKYLVSNNEVFWSKGTELRICEIEEKEEGSICKTTKENEEYEEGLYCASKGSNVLYLLTGKATSTQNTVNCISRKDEDKYISSKKITKMNGIELKNKLIEFNKNAITLVRDGYYIISQNDTLISSDIANNEDVEFIIYNCKDTVCSTNVSPGEKLITNEGEIIEIDEEGKLVSLTENGLSFFSKEGKVCDESESEVGIIINVSENGKVNESIGLSDLQEGVYINESNEDVVAVKENGEWMIKSVKCSYDESKGTCSNEKVEFAVGDYCSYEKKLYVITETVEDEESKCVVGGKESPIIMKSSNGKLISVEEKMIQFIEDDGYYALSTDDTPFENVEMAESKLIKCEDDECNEVDVEVGSYLNKAPIVSNIVQYPSGKLEESVKSDKKCEINEEGIVSGEDVNVGDVCIVSQSLYLVGDDMRGNEVKKEIISYKLVENSLYKLNDDAVVQIFDGYYFVTGEDLPVTNVKDYAKVDTVGVMCSSKGYCFVMEPSILGYYPDYTTKNGKNFRIIKYNPSDKSGKREEESSGYEVLSEEGIYKMDDGSYAQCEKDNNDEVVCHDIEEKGAYVTVDDEVIVCVEDEDEEVQCSQATNGGYYWIDKKLYECDPSEDGDKLDCKEVAKEGYFISQPEGDLYECEKVEEETEIVEEETADVSKIYDGLNAGGEESSEEEDETTTTTSTEESTTTTTTTEESTTTTTTTT

SEQ ID NO: 27326 - protein, 5884 aa, Neocallimastix californiae
  ScaA scaffoldin- protein sequence
MYHNKNCIAYTPCSDVGCITISGSTVNLKGSIDYPMDRNDGVDKQYLLYDVEPSKFPGVTVAGNYAVQMKIAKKESNDKGYGTVTLNELKTTCTDTPDNEIIKHNGNFYYCAGGIEVEMKDSGARFAISINGEYKIIDIMKTAAIEKDSTLVDAYLGYYVDRSSGASGVVHCEKKDADGAEHPSDYMECAAKTVDYVDNYEVFVNKELRFPGSNGSELNAKLIICSNDEGNCKVPEDNGGYHNPYIKEKELMGNRFYINHQNSEKTLIYCSSMTYCFEMSSSSNPELVKGIYINGVEDLALIKCVEDKTTNNDGEEEIKIVCDSMASVEKYGYYVNYRNDTTIRCDLESCILISYDNHKRTFINSDSESDYRIIKCQNGNECKVVEKSQNYYIDSSSNSNALIKCSTSDNTCTKVTGGNRDVYISGDGEDVIICTTNSCNYQNSEATSADVDQTYYLNADSSAEIPLITAVEVKETAVTRKKRDQTYKWSAPEEKPKSNSVFINKNAISEKYGIIYCTSETQCNEIETFDTEYIDIITPKVIYFDGLNNEWKQNINYLTSNSLDSTYIFLVNKLNAEIIKTGGSNSSLVSCKKENNAWSCEYLTSGILNYYVYKYSGDKLITYSNNDFTISSTMDNGYYLNSENIIKCTSDTCAIYLGVESCTPENVGAIISTSNELCVGYDSTATNENDKPKTVSINDNQKYLIDSKKFPGYSNVISNGSILINVSDNKILQVKPNNDEYYLISSDYTIIGAADTEGTVYKCEKASGSNPPICTKQSQTDTKYYPNSDSSSMKNYPNIKCEKIKDEENSTETVTKYKIPCTLSRKSGDEVYCLKANNNNRLSSCIGNCGVNATCYDITNTIGYYLPYQKSNLIECSSNCKNYTVSAGYYASADISKSLILCKKSVDGFRCDYEDDVNDGYFIGEKSSSLVKCKDNVCSKVTINASNLGYYVSGESGNALINCISENNVIKCVADSKPVLGWYLNAAVSGNSSNEKYLIKCVSDNSGKITCKEMEVPNKGFFISAFDSSKLINCEDSSCSSINLYNGYYVNGETNQLIYCINNVCTEENGKGWYKSIYYDNVIYCNNGCKKLDVNNINKNGYYINSDSRSPKYPLLEIRYSNLIYEKSNYYNGWYLNADTNDSNMIIECNSNGIVPICNGKTLGSGTDCSSSNNGKFINDNGEIKWCINEEKVNLVSNGPTVIAKITGRNFIPWISDASGFVIFSVGSKFIIQKKIDGYYYDDKNSELYYCSGSGSGICNKIEKGNITPGYYINYTEKTIIRCGRYDDKLCETFSSGLSCTEYNVAFRSNDIVLCTNGGYVTMENINIENIYALDIKYKSGNPTFPKKSDSKYTRYILADVNKYYVKYNEAIEEVSECPENSNTDEKNDKIVCMTTGTNPKLVQVNNLDKTIGLSSSTIYYVSKNDELKNIEYDADTNNGYFEYKGNDLSNSNILSTVYIKKTDKNKVEFKYVCPIGGICVRKEKAEEPVLGFQFENGILKMQKRNGKSNEVTEKIMPGIYIKYDGTSTNRNEVINCYLTSNGVKCENINKTSSGISYDGKNISADGVTSNKLFSKFVIKKSVNKRDNNNESNVLIIKELTATSYNEAEFTSTTNIFLNGDLKKITNDIIATQDETKVTGYICNNIGECKKIENSGNKKYLLNTAQEGSIINAVVVCGNHGTEGDKCKFINAQEGAIYENYAATGVNDALITCTSSGCKTEPALSSGELPQCEYSSLTRDIVKDEFGSCIRADTQKSLGVNQHCILNGLIYMYDGSVCSTIIRSETIGMKLFDATLRELTISKIVENHYGATLYNCPRSNGGCYVTSGYIASTAQSAAGYSICNSKNGCTYISSSELTNSCSEAGEGGLILDNKYIKLCKNGGRDISTNTAGYYPVNISVNDNFPDSKFGDKLLINVDINNNMAVYSMVLTDGYLLLDINSKILRGEALAISSGNIYPSTTPCTMDKCSLYICESDNRKCEIVAEAEKQYGYYTSTSYSKDLITCTKNASKNLVECKLTRDAIYFVNIIDRNIIDTIIKDSINSASISFSSNDNNKYFSITTGFPGFSDSTASNAVKLSIIAEAKKYSITPLKTDNYVLLNSYENRLAIKTESREIKNIYLCNSSVGKCVKNDVEDGWYISGQSGYEGIRCENGSCVMKETLNKSCSGEGDFIIKENVYQYCVIKNKSITSIKITENVGKILQLTSKDKKLVFPNNKTFTVVYSNSVKGIGYSSSESVDTPNGLTLCTTVNTSGNGNCVKENGNQLLSGEYCLYGTKIYSNVTEASVSKCKQQFTEGVSVEVFYGTKKASATEIENPGTQMFYCKNGECRVTTGYKKISSYYRCDYSKCTKTNGSTGYENGDLKSSKLVTADGEKSFAKDTYFYINGSNNFPGTETYQSFIVEVGADYAVPFIGNGYYLFSSAGAMLTKDPKEEGYVTTAKTGNKLYLCSNTDNNCVLQQNTNNIIENIFYSNAGISDSKKKSIIGCYNTGDKKSNCVIAEDAVIFEETYNKCEFTGKLVRTTSKADSEGKVTYGDYKLCTARNGTPVAIGDAAGKPKYYMLNMKKNDTFAGIDLTGDKVDENYSRNILIEITDNKLSQYEKEGYILYNASANEIIDSVGSTKGVLYYCARSENFKGAGKYSYECKVESNINNGWYFNSLYTQDKRLIKCVDGVCYLSEIKESNKCQYSGSIIYNGGFKICQTTDKLIDISSINNKNTVEIIMNIEMMTEFPGMKTNHTDILLSIMPNKAYQVKLKTNVVVREDNTIVSGVKGDLYECSVDGSCLMNVVPKDNYYIKSNSTGYDVELVKCENRKCIVVKDELGKGKGIKEGFRVGVNKKTPLIQCTQNGIQVEDKKFIQYDISTCVEKEYKEGWYINSGSDSDTKPLIECTKESGCITKKPTKDGWYLNAGANNIYSVMTKNNSTVYPIIRCEGGNCNYYKEELAKECTKGGEVIMPSNGNYKVCKSVGKSLDFSKSNTVELINNEGNFPGSSGNIMVVPSSTNIVIANDGYYYKDTLYECRGSCTAYNTDDKDGKMYYDEISGNLMVGSCNGGICSWTANKIEGNVFLDDRNILVTNQSNSVSKIYECTKNANKILTCIEVLENNSRGYFINNEIKDENGKSQSLIYLCTGNDCQVVDTIPKCTELSYKKNYCYISYYDEPNSEDYVSSEPVINAGEICVSNINTNSQKYYFAIKEINTGTDQINCISMPSDASESYYQVGNVIYSQNKYNVRRINYSYSLINGLDSNSVIKDSTITNEINGILVEDHENFVNCSSGKCEVNKMLSCTYNFQTEKCSISSGNVNAGQICKSAEGNIYFALEKLSSNGGRCVNHSTSWSYSEGSDTVYPNYSNGQNVSNEKYENTYFVVDSKIYMIEYDNDIYALGEGIYIIDEANKRVNIYKEVDISKESKFTMYVCTSAGCKVKNNCASGINYEYMFDRSTGTVISCDPKSNKVKNIYSDGYYLNGPWENLIKCTNGNCVNYDNKIGREGYYLDQGNQEKIIKCIREDEKFKCTLEDAIQCTYNSKEGVCASTVDLLRNSYCLYVVKDKKGVIIGTPKMLYIENYIKAKDIGKCISNEGEDTFYYHYRKSKFLGNNERDEIIQYSRNAISNIYEKEYGYYIISTENRKGLTEDTKLNRSRLYECTSSGCIEIRDPIDERIYVNKASMEKMVRYNGKSKTWEILKRRCKQNKVNTAQCELPASNFKSGDILYMFEDGDINPVFKASKYDLNTKNTLIDDNNDFVDPKKYQYFNTEGKMYVFNKNKQYFDIVDEEGYYMFKTSTYYHNLEPYRSTVNTTNTAALKVYRKSDKWYPMEEFGNTYTEGYYLNKADIEGDGIAIEVMNIPLKSDDIDGESEEEKKIREQNSKVKKFKAVINKCTSTKKNICNPKIEGQSINKGSVCVVTEGDSKGLYLAIDNITKASSAVNCIRYDGENTYHFINNNVIYASQPREKLIIEVQKNKIIPFTSETNMGYYIIEKNEKKLLNSNNAIDANAYNCGWYYDLFTEGEKAGEENPETKRYECNSETIYNRYIRSKNGDVIFGKSTTKWYKESKKGYYFFNDKYLAATITKDEDDKDVPDTITYSNNVSNSGTYLNSALIGNKNIIVENDNGKQTIKTEYKTCVVSGESCRSSVTTNELSNGEVCLGSSKNNLYIVEVIEQDDGTKKRFCYTGSDKLKYRYVNNMLYRLDGLSVQEVSRGYYVLNKNWEEYSSTYPEVPNAIFYCDGRCEKITSVEIDSEVLINEAGTGNNKLLRYFPATGKLVNVYEPGYYLLNSKSGVTKESGANDYNGNMYYLNDNGVLSTIPNSFGYSNIYINKAKTGSLTRFYSEFENSKVSYNVKTGLLEYEGKANDGDEIVLVYIDGLLYKQLPYSFEVVEEGVYAIKDNLPFTETVWTELNSSNNEICYYKNGSCNDAKLNEIMKQKYTINNATKNPSVIEHGENGWRMVNTDGVYFFFEDGYSITTTDRRIDRVFEVLDGQSVEITEDENRLGYYQFNGIMIESNTEKGWEDGVVYIETVEQEDKRKCTSYEFGEIIGNDKFCFNNDLGICLPKTDISNESVNINNCIFSSDGAVYYFLIDDKLYSISGQAMKLIKKSGLYIVNSSKKIYEDKLENKATAYACENGKCEVATSLSTGYYLNMANGAIEEPAILYYDNSSKTWRMTTNNGFYFFNSNGYAVSDNEVVKYAFAISENGNEIDNIINATEVGIYINQSSGDESIIVENKGKWEKAKKIPSCKISSDGVVKSSELMKVGDICLDEKKLVFISGSSNGSKREEEYSYEGVTAVDDEIKYSYDSTNNAIVKLEEGNMVKLNVSGYVIIEKGTSLPIEKLSEANVYKCSSGKCDVVDMQNVEAGTLYVNSISEETPLVKYEGEGQWNIVTEEGYYFFDSDSIAVKENAIVGSAIEITVDGNEQIVQRDISASKELGFYFNKASNNKVLISNDEDFWSKGTSLHTCNIVEVEGGFSCKTLKDTLDVGDYCYDGEKFFLLIGEAAPDTEEINCIAGSNDEPLYVTPDVVKTINSIDVGSKLVRLNDDSIKVVSPGYYILNVNGTLIDNNGEKGEVQMTIYKCDENDCEKEEEMEKNVKFLTESGEIFEIDEEGVLGKVNNEGIYFFNEEGKACSTADDEVSTIIRINNEGLKQKVDLDEMSVGTYINNANNQSVGVYDGKEWTIEESECKYDAEKKSCSSESKNLEVGSYCVVEGNIYVVSEIDIETELTICIPGNDDVPIYYMNDDTLVAIKNKSISVIENDGYYAINIKTREGIKSEIPVQGVFIRCESNGECSSVKPEKNSSYLNKAVVDSNIVKFNEKASLKQIKTIETHCKIDGNSCSADEGELVAGDLCVADSNLYLVKGEGQCVMAEKFVERYQFVSNKIYMLGEDIVVQKFDGYYFINSDNRVIGSVEDYANPDTVAYMCSTKGDCYIVDPVEVRYFKDYTTEVDGKFKVVRFDPSKKTKRQEQGSSGYEAITEGGIYKLDDGSYVECEVENNDDVNCKDIENIGTKETIDGELLTCTKNDDNEVECVQATEGGYYFIGDTLKECSSIDGVKLECTEVKKEGYFLADNKSELYECNKKVEEDEEMVDISRILNDLLGITENNESTEIIEELNGENEEIEIVNKKREGENTEEGDQVEENENDNAENGENDEEQKEEGENEDEEKSIGPVEVTCKVIECTDGATVNSPGENGEELYVCKKIEKPEKEETNDNENDEEKEGEEKEEDIEEEINRWIVNEKCMSGNYIKISDTTVECEDPKDSIKEENIEKPNESHISTERKEPKTTTTKSSTYTTTYTTTTEVEEATTTSSSSPSKSNTTTKKATSAKPRNTTTTKAVETTTTKTTTTTTKPAATTTTATGGTVKMRPIPSMVLYFVLLVFAYLLHH

SEQ ID NO: 27327 - protein, 6213 aa, Anaeromyces robustus
  ScaA scaffoldin- CDNA Sequence
MVNFKYLSLPLLVGLINNFVRGAEVVVRTCSFEKDGNDYGKYKLVTDDKATPPVTQPNCVTGFYLLGDDLTTVVATGKTGKLYYFDKTTSSNSRLFNNPVPGYYKHAYKDDTNDIVEFISCNANGECKFMGELTESTCNDSKAGSLYKFLDTSSTKSRSDPVPEYRLCLGAFKSGSVGYLNIDITEGNYLVKNNGNIFNFNNAVDYFVVKSDGASITFDPTYTRREDQCVNKDGKLITRFEDFCDTENSSGKYITCMNGSCIGTSQENGSKTNISADPCEITVTAKTTFVDASCSASAKCNSNNNGYHLGTDATGNKYLTLFNVSGDKRTCEVIEEPSVGYYRLALSKISVSSGQIKDSYQYVIECKDINDDVGCQLIQLPTTEGMECDSDNAGKLINSNYNAVLCLDENESQRFVGSDPVKKFVKAVEGSIFGRTAQKYYPVDITSNYIIYDKDYDKSGILMDGGRVNCNGSPSVCSVSNLKFNPSYTYTYVETPTKTPTSQKFVPSATNYAATDKGYYFIDDDGKTVTDTTTDGYIVYYDGAGSSTTVTEVAGIYMNHDGLTSTDFPYIICKIKNIKIDETQNENVEITIGGKTYNNIKVKKVKCNLRAEPTTDICSTDGNLVKISDDNGEESVGLCVNSKGIKFESHEYLYGLDNQSIGFIEGQRYYELQIGQVVDKDTNKVTDEYIKFNTVSKKGYISVSNDSDVINCVKRDDATELDTSNCNKVTANEFDYYYYSEDYIIYCDGSKKCTYLSRSDYVGKNGLFHVIYGGDRTYVISAKSSGGTDAKFKIQKGANYYPVSSGSSSNYKFDLINCSGVSCNMESGIGRGVYLYGSDKGLIICTASQCGAGESTDNPLQSDIGNKYYLNAGSDKEDKPLITVKGVEITSAEGTKTIVYKWVTDAASVKTLYVNENGNKKLIYCEAQNSCEEIDAVSSKYIDGLGKKVIDCTVSGNKCNKLEMFTQSQYGTNVYLIDNNNRILQDNVVSGSLIKCTYREKKEGEDEDQKSCEGLEVVEGNYYVDSYGSNLIDSNKNIIIKSKVASGYYRSSDENKYIECTKGTGCSEKDSAADCNEDGSAGKIKKGSGDLTLCLDENATLNTSGKHIKNLSYFPGSSGDILISVESNKIVEVTPTSIEYYITDENGILLTEGNKAGNLYKCSTAGCEGGNVAGIYNNADINTVVNFQIIQCDDEAVSKRDGEGPTCIGKERDTEINCLTNNNLYSCAEDAKCDSTFEGFESVCKQQIVTAGYYVLPKGSNEGIIQCTSSGATVSCEKNTEVKEGYYISQDRSKPLIKCEKSLGKVMCISVDIEDINDGVYLRKVVESTNVVNALLKCTGKLCEEIDMVTGYYLSGEPDKKLVYCDGTTKLCESDSKPSEGWYANAVQSGKGLIKCTIDGSKSFECNEEVTKVGTYINAGVKEDGKKLIVCTLSGCTEEEPEVEAYYVDGENSKLIYSDINSKLILIKDPGVDSWYLSKEGEGNLIKCYSENDNVVCKEYMNEQLGKGYYINGDSYSNYEYPLIRVISSTNSNFEKGKVSTKGWYVHEDDDVGKKIIKCTSESSCSLIDVSVDECSLANGKFSTYYGDIVWCNGEEIVSIRDTSQQTYVVAAITDFDKDIVLPDGYVASDTYVILKKASGNGLSLAQVNTNGYYYDRYKEKLYKCSNDSNGYCTIISQDDIVDGFYFNFKPPIDSEKIIRCENKKCSYYTLTNTDTKCGSENVGFKNGVYLCQNGDLSTTFNFEELTSEKVYVLKSKNFPGVKGRYVMVNISKYSLLFKEEVEELAKCTTSTEAGSVCLSVTAVKQQSDKYTLVKGTTTITTAGDIEISVSGKDEKIKYDFETNAGYFKYNIKSGEAELVSLFIPKEDFKYECKIDGQCIERELAEELIYGYDVTDEGVPTKIVAKASVKRSDDDSKVIVLDEIKNGWYAKKGSGCIECKDGSCEPKTSCVIERETGTANIKYGTYKSDPSHNKVVSKINTGKRRRATGSDSDDIVIYELNYVSLTEINDSRNIFTDGDNVVLSSDDSTISNAYSCIEGKCKRIVVEDDKYYLNTIQSGKKINAVVKCYKVTGGSQGTSCIFIDAVEGNMYENAAGTGIEDALIKCTNEKCEVTKAESEVAMIPECKPSLSTNDPYINPITLNCIRSDNSLYLLQGQHCIYKGDIYIYDTYTDNSNPTSPKTYLKCYNVNTVDTSTDVKMFDITYRKINIENMKEKRIGSSIYTKVGNGKWHLTNGYIVNVSTKVFSKCMKSECEEMKSIEGTSCENEGAGSLILDANKNIKLCKSDVSSGAVDISEDKYYPIELFIDGNFPEASTGDRILVGIEKIGANNVYVISKLVSDKFILLATGNAIASSSHADNKLYQCTSSDSNCVILEKNNGWYSSEDDGKFIKCEDGTCGEVSEATEIEYISEKFDSIDNGEFIYKDNNLMIRDENSFVQFKVNNYVLLNEYENRLAEEDEVKEMKVLLKCNESYGKCIKEEDIKDGWYVNGDTEYKGIKCSNGSCVVVKELSNSCGNNNDGDLIYDTSSNEYSLCYSKTLISLKNNVGKKISLSSNNKFPNNKDYVVVMSNSVIGIGNIGGVGGNVESSVCTNNCKNGSSVQCKITVGEEDIVLPVNSYCTLVQGEDITIYKGKDAENSEKAFTEGNSVILIDGNSLITNVDNVGPSTEMYYCIKGSCKVGVGYKKLGDSIVKCGADGCEKYETPGSVSIGDISSGNLQYDESKSGGGDSNRLYYYINKSNVFPGSENKSSFLVEAGLDYYVIFKGKGYYLLGSDNKMLEGSSAKNNDYAGDKLYLCDELKGNCIVQETKSNGYFVNAVDESMILCKANKCYIAYIVDDSCSKLGNVVKKDGKYKFCNVKGTNSPIEIKESSSVNYYMLSLGRGDKFAGITIPDEEANDEVVVNIIVKYTGTTLTQYTKEGYILRNGDNIVENVNGSGNMYKCEKEKYIGTTETVQCKLMENINSGWYFSDNYENNKYISCDNTKESNKCNLMEAVESKTCQNSGILIYNNEELKVCVRSDKQVGIKGISEKYAMIMNVSNTKDFPGFKVKTTNIEIITSISSNSVTWVDMDTFVVVNDEKYGRRVITTAGSNVGGKSEEGNLYRCTAQSGCKVSTNPEENWYIMKDISSGEPNNLILCETESGSSDSGESKMKCTMTDKNVKEGFYANWNKEKPLIQCVQPGEEKEGKFTNSAGKKVVCFEKDYKEGWYISGNGKLINCNKEFGCYEESSPRYGLYVNNEANDNIYKNEEYTNKTIYKLIKCKGGSSANCVSYTKETVSQCSNEKPGEINVDNTGNYKFCLSKVDHTSDKVEAVDFIKSSGKKYGILKISSTTDDFPVSEAGYNLVEISSNEISVVNKEGYYYIDDIMFNCKSTGKCEKETSGGITVLDSVSNVMMTSPCTEGSSCNDNWIVDKSDGIILLDTNNKIISTVDNVNVKKAYKCKDNKCIEVNYEGYYYNKNAQDENGNNVLYQYKKDKNGVMKWSIVNNELLNCRQLSEYKPNNCYISYEDEKYKAKLEEIKVDAGGICVSSTNKYLALKEINTGIDVENCVQMPSEADVSTYYYNVNGNAYAVDKYSYMNIGGNGQGVVINSLNGEVINNNKKLNKILKDDYNTASEYIISCNEGNCVSKVASACTYDFQSGKCKALTENVNSGEVCITENRIYLALENLTTSSEGSCTPYLYKKMNSGEDVKDEGDSLIKVANKKLYEITSSNEIYKYSDGIYIVNEADRVVELEDDKEIDISGKSNLKLYVCNKECKLKTSCGVNGKDEYMFYKNDNNELTYDKLYKCNSKNNKLSIVKERKGYYLNSAFNNLIKCYDSGDCKVLDEENGMEGYYVDGGNEGLIIKCIRGTEKFVCKEESVVACEYNSKEGVCKSEDNLLRNSYCYRSGKSNENKLIYVENFIKAGDKGKCIANDGKDYFYKYKKSKFLGHKERDDLIKFSEDSIVSIFENNIGYYIFNTETHNGVEKSVELKKTRMYECKKQNCEEILKPQINKVYINKASTEKLIKYDGSQKSWDVIKRRCVINNNNTKQCTLSESISKGELIYVVYDDEVKFYKSRYDVSNYVTRNPVNDDDEKKSHYSISDNKYHLLQSNFDPKSKVMLMLNSGKQTVDWVEDEGYYIFEKSEEEINLIPYRNTQNVTLDKKTEITVYQKGDSWKVISDVVKTFSNIGIYWNKASINDEGVVIQSMSIPIKEEQEEEGSARRKRATGSSGGNSRIKSVLNKCIVNEKNKCINVQEGEIIPVGSPCIVSDGEYSGLYLAISPISENASSENCVKYDEGTSYVNLDDVEFSGGYVYNSIVRVEKNEMLMFTDGGNDNNPYIGYYIIGEKNKPFNLTVQTELKGNSKGAYLCGYRMEENPDTNEMKETDIYECSSYSGEDAYYYANDNIGSNGVYYGKGNKWMKESSSGYYFFNSKNVAANIKEEIPDTGVFDGYGNAVNNGKYINSAVTDSNNEIVVVNNYEGSYTINTDIKKCKVNNDETCDGDSEEVTLTDNDICYTLSGNTKKLYIVEVSVQESGEESVTKKLCHTGGVDAVKYYMSGSNLYRLDGLSVQGMKSGIFVLNDKMEGFSSDIYEIPYKVIECGNGNCAEKEIINVESDVIINGAGNGNNQLLKYNKLSKKFMNVDQPGYYLFNEDGSVNGDERYSKLYELTKDGELKTLTEDDINMKNIYINFAKEGEITLGLKKIVSGIIEYDSGNKFLKIKNSNKIENVFVIIDNKLYKKLTRELDEVDEGIYAMKKNGNVFEPFINTVEENLNTAQYEVCYYDGKSLPCNVQKLEEFKKRNVMVNKSNGKENVLEYNSGTKLWKIVKDDGYYFFFEDGYGINKADNRVNKVLQIVNGNVNDVTEGIKKSGFYVFKGLMVENTNDKWEDAELAVDNVVVTGRKGCKSYEIRELIEPQEFCYESSRGICIPKVEISQKSDDNNNCMFSTDDGIYYYLVDDSLYALSKDSYNRIEKSGIYVVDLYGKIYDNKKENRAIAYSCKEGKCGITKSLKSKYYMNFANDNKEIPVILYYDSEKSTWVKTSKDGYYFFNENGKSVSVGKEVAYAFEVRKEGMEIVNIMENVSDGKYVSQSNPSEAIIVEMKGVWQKPVSVPTCTVEEDGITVTSSEPMESGDICIDNKQIVIIKGESELAKRDGEYSYKSVSSVGRNAYAYIEKDKQLLRVKNDQISVVNVNGYVLLDKSTGIPLESNEEVEGELYSCNGKSCELVNSDKIDVGNRYVNKLAEKLPLIKNVDVDKWAVEMEEGYFFINNKQKAVVAKDTVISAFEVLNVNGVLIQNDITQSNSPGIYVNKGGNVKSVITNDGSSWNAGEIVTCKVTENKDGTSNCKTFTEEETIEAGNYCYNKDGKEVGNKMYLITETATSAIETGNCLSAAAESPLYLTSDKIGGKLNGTAVSKLVKFNGEYVTLVKPGYYMVNQNNKLVEESGENVLIYVCDGSSCSVDSAVLTTGERFLSDGKIFEYDKDGKKLKKVTEIGLYVFNSEGRAASNSVDENNILLMNEDGSIEKIELESGIYINIANKNTYVVYDGESYSIKSVTCTYNKDGGSCANESVIFNIGDYCISDGKFYIINGLSGENNEIKLCKVGSDETPVYYDNGKQKLIMVKEKEIYTVSEEGYYAIDVTKERALDSEDLVNTKLIKCDNGGSCESVKPEVGSYLNRAPDPYAIAQFTGEEDKAFTIERECNVEVSENGQRCVVEDGELNAGDVCLSSNVLYLVGEDNNECVATEKTVDTYKIVNNKLYRLNDDSVVQLLDGYYFITKEGHAVTRRKDYEKEGTVGYICSKKGDCYQIEPEGVRYYIDYTTMTDNHFVVVKYDGSRRDLRKRQEEEGGEEEEEKEENTEKGDEEGEGEGNEANGEENEDEGNVDSFEEEEDEGEESEGNTSGIENITEPGVYKLDDGSYVECELDNNEEITCKNIDKEGSKMTTDGEVVACVKNDKDEIVCTQATEGGYYYIDDELMECTATEEQDKLECEKVDKEGYFISEPNDLVYECVEVEEEEEEEEYVPDKDLEDPDLRKRKQKRFKEYNVQANEVNGEAETESADANDNETENDEPKNVKCRVMECPGDPITIKLEDGESKDVYICSTGEDEESRYIDPDPESSICESGSYIKKGEDYYECDEEEKGKLDPNMLVEPNTEHTTSYQPRPTPTTAQETSAPPTKSSETSKPTSTPTQAPSGALSLIHKIPSITFYIILFVFAFLIQY

SEQ ID NO: 27328 - DNA, 17252 bp, Piromyces finnis
  ScaA scaffoldin- CDNA Sequence
caagaatttcatttcttgttttttcattaatataaattagaaaaaaaaaaaaaagtaaagaaaaaaaaaaaaagaaacattttaaatcttattaagattaaattgtaaatcgtctttttccttttgaagaaagaaaaagatatttcttttcttgtaaatacttgtagatagttgttgtaaataataaaaaaaaaacttttgtaatatataaacaatttttgaaatttatacccgttttcctttaaactttttttaaaattttgtaaatataccaaaaaggaaaatatggttaattttaaacgttttggcagtcttctgccgttattattgggaatttccaaagtattaggagctgatgaagttgtcgaacaagaaggaagtactggaaatagtaataccccaaagccaattgaatataattttaatgatggtcaactttatattaaagatggagttacagaatcaccatataaaaatccacttcctggatattataaatacaaagatattgaaggaactgataattatgttaaatgtgataggtatgaaaaatgtgaagacattacatcatccttattaacaaaatcaatttgtaaggttaatggagaattaataataaatagtagaagtgaaaataaagttggtatttgtttagaaaataaggcttatacatttgtagaatttggtgaaaatgataaaaactatgttgtttcacaaaacgtagaactttttggatttgatgctaaaactacacatgttttgttaaaaatcagtacaaactctattacatttgataacactgctaaagattttgaagatcaatgtgttcttaaaggtgacaataatggatatatcgttgatcgtaaggtagatttttgttctaccgattccacagatatgtattatacatgtaaaagtggaaagtgtaccactaaaaaacaagatgattatgaagatgtagaaacagaatatacaaaagagaaatgtacatttattattgacgaaggtactgtaaataattcttgtactaagaaaggttattatttacatgtagatggtcaaagtaaaaaattaattgaatgtttagtaacgcaagcagcaccattaactggaagaagtggagaaatttcttgtggaataaaaaccactactggtataactggttattactggaatgaattacaatacaatgaaattataaagtgtgtagatggtgattgttcacttgtaacttttgaagatgaatgccaaaaggctggtgacttcatagataatggatataatgttaaattatgtaatactgcaagtactgcttttgtgttcaagggaattgaagataaattaattgaagataaaaaagaaaacaattatattgataatattttcggtgaagaaaatattagatatgttgttgataccaatgattacaaagtagaaataaaaaaagaacatgatataaaagatacaattttagaaaacaaacactatatttgttctaatggaaaatgtaaaaagactgacatttctatcaattctagtttagattgtaaatacactaatgctaaattaataactgagcaaaaatactttattactgctgatggacaatttattcaagatactgacagtgacaaagataaatattcaggatatttaattagtattaaagaaacaaagtgtaatgttatttctaaatcaaatggatattatgtttttagcgaaagtcaattagttttctgtaatacagaacaaggttgtaaattagataatagtgtattacttgtagctaaacctacagattatccaatttatcttttgaattctgataatactgattcaactaaattaattagatgtacctcatcaagtgaatgcaaagtttataaaggtgaaaaaggatattatcttgatggaagtgtagattcaaaggaacttagtttaatttattgcaatggatctacttgtagtgctaccatggtagcatcacgtagagcctactacacaaaagatattaatggggaggttactacagaaggaattattttatgtaataatggatgtgttaaggctacattaggaacagaagaaaaatattacttaaatggtggtgttggaagcaatgttacgccattgattcatttcaaatctggtgcagacccagaaattgaagtaattgatagtagtaagaaagaattatacaaaaatgctaatgatgttaaaggatttatatactgtagttctccaactgaatgtagtgaaatttcaaaattccaagataaagaatatgtagatgttaaagaaaagaaaatccattattatgacgatgaaaaagaaaaatggagtgagtcagatattaatttagaaacaaatggtgatagtaatgcttattacgtaaacaaattaacaaatgaaattttaactaataacaatgaagatggtaaattagttgtatgtagtaaagcaagtgatgttactacctgtggtatagtaactaaagaattcaagacttattatattaatggtggtgatgatagcaaatcattaattcaatatgataaaagtaaaactaaattttctttaatgaaaaatgtggatgaagggtattatattaattctaatactgatgtaatatcttgtaatgaaaattgtgaaaactttagtatacctgaaaattgtgatgtaaatgaaggaaaaataataaaatctagtaatactaataaattttgtatttccacttctaaatcagtagaattgaccactaaagaagaaaaatacatggttggatctgatagtgattctaaaatatacaaagttaataacaagaatgttttggtagataaaagtgaaggatattatttaattaaaagggacgacactaaaaaatttgtaagtgctaaagatattgctggtgatgtttattattgtaatggtgttaagtgtgttaaacaaactatatctgatgaaaagtatttaccaaatgatgatgaaaatacaaattccaacttaactaaaatttactgtaatggtggtcaatgtaaattaaatgcaaagtcagctactgaaaattactgtattaaaacaaatgatggcaatactgacaaatcattatatgtttgtaaagatgcctgtgactttactgctcaaaacaattgtagtaatgaaaataataagattggttattatttaggttactataattcctacttaattaaatgtagtgataatggtaattgtgaaaaggaaatcctggatgatagtgctattggatactatttaaatatggataatagtaaaccattaattcaatgttacacctctttaggtaaaactaattgtgctgctgttagtgaagttaaaaatggttattatactactccagaatccacaacagatggtaatattattaagtgtaataatggaaagtgtaaattagagactgtaacagttactgcacaagaaataaaatattttgttagtggtgaaactaataaacatattacaaaatgtgaagaagtagttgaacaagaaccagaaccacttcgtagaagtggtgttgaaatggttacaaaatgtactgcaattgcttctccaaaattaggatggtatgtcaatggagacaaaaatgctaaaactgaaggtcttgatttaattttatgttcaaagaccaatggcagtttttcatgtattgaaaaaccaaagaacattggttattacttaagttcagaagataataaattattaaattgtgataaaacaggatgtaatgatgtagttgatctttcagaaagttctgctaattcatattatgtaaatggtgaaaataaccaattaatttattgtcaaggtccaaactgtaaatcaattgatgtcaatagtaaaggattttatttatctgctaccaaccaaaaatatttaattaaatgtgacaaggtcgataaaaatattgtttgtactgaattaactaaaccaggtactaatggtgtatacatgaatgctgatacatatactttatctcaacaaccattaattgtttataatgatgatgattatgatgattctaaaagcaaatttaaactttctggaaatgacataaagaatggttggtataagagtgctgaaactgatgttttaacaaaatcaccagataattctgttattaaatgtaccaattctagaaactgtagttacgtaaaggtaaaggatagtcaatgtagtccatctattgctggtgaattttcaaaggttaacggaaaattacaatggtgtaaaacagatggtagtggttttgttgattttgtcaatggtgaagttatttctgaatttaataaaaatgataaaattccaggtgtcaatcttccaagtggtgttaaaaaggcctacgccttacttcaagtagataccacttttatagtaagatcggatgccgtcgatggttacaaatatgataaatccctttacttctgtccaaaggaaaagtatggtatttgtaccgaagttagtactgcagatttagttccaggtatttacattgatcataagattacaaataaagaaattaaatgtagtgaagtagataagaaagtaatatgtgaagagacagaaaataaatttgttacttatagcgatggatataaaataaataataaagatatgtatggaattaatgtagattacatgtatgcatttgctaataatggaaattcattcccaactactggtgattatttcagagcaaatgttaataaatactctataaagttgatcaaaaatattgaaggagttgaagatataactaaatataataataaatttgattctaatggaaaattatttgtaaataaaattaaggatagtgaaggaaaattaaaagaaaatgatgaaaacatagatgctaattattatgattatgatactaattacggtttttatgaatatagtaaagtaaatgaagcaatctctttagataaagtagttatttactttaatgaaactgaagaatttaaatatgaatgtaagattggtgatgtttgtattaagaaggaattgactgaagtaccattaaaaggatttaaatttgattctgatgcaggtgtacttaaaccagaatttacatccaataaggaagaaagaaaaattgaatttaaggtaggtacatatattgttggcgatagagaagttacatatgataaagatggtaattttaaacaaggagaaacaataccaaattctgatgatgcagatgaaggtagtatatgcaaggatggtggagttgttgcatttaaagttggtggtactaaaacaataaaatcaagtaaaagagtatccaagtttgtattcaagccagaaagcgttaatgctagtaaaagatcagaatctgacgaagcatatggattaatggaattaacacatttatcctgtactgtatccaaggaaattagaaatattttcatttctggtgaagatgatgatgaagaaaaagatcatattatgattactgaagaaattttagatgtagattctgcttactcttgtaatgcaaaggaatgtaaatctattactgaaaatgaaatgacgagatattacataaatactgctcaacaaggtaaaattaagaatgcttatgcaaaatgtggatatgatgataaaaaaaaaaaagtagtatgtgtattattaaatattaaggaagacgataaattattatttgaaaatgctgcagctactagtgccgaagatgctttaatttcatgtaattacaaagaaggatgtaagactatgccagttagtggtaaattaggtttaccattatgtgaggaaaagtatgatgatattaagcttacttattatgttcgtgtagataatggtgaagagttagaaaaagatcaatattgtattgatgaaaaagaaaaaattgtctcatcaagtgaatttattgaaagtgaaatatttgtatttgatatcacctatagacaaattgattattcaaagataaaagaaaatcataaattcgcatcaatgtattacaaaaatgaaaataatggtaaatatgttcaaacttatggttacataacaagtactgatggttattccaaattaaccaatgaaggtttaacttttattaaatataaagatacttataaatcttgtgaattagaaggaacaggttctattattaaagaaggaagtgatgttgaaatctgtattggttctgaaccccctagaaaaattactggaatggacaatacttataatttattaaacatcaatttaaataatgtttatcctgaagttaatgctggtaataagattcttgttaaagtaaaaggtgacattgtatattcaatttatgaagatggatatgttttaattgattcagataataaattagttgaaatgacagtccaaactagaaaacgtgaagtagaaccaacaccatcactaacgctttatcaatttaatgttaataatatgtattgtgatagtattgaaaatccatcaaatggtatatataagacaaatatgaatgaaaaaacaattaattgtataggcaaaaaatgtaatttaaaggatattgaaaatttacaattttcaaagaatattacttatagttatatcaaagataaaaataatctattttcaagtgtatctactgatgaatttattattgaaattagtgaatacaaaataactccattaattgctgataattacattttaatggatgaaaaactttacttatgtaattcaaataaggaaacctgtaatgaagaagacattaaaccaggttggtatatttctggatctgagagttacaaggccattaaatgtgaaagtggagcttgtaaaactgtagaaaatttaagttcatcgtgttcaaagatgggtgatttaatttacagtacttcagcaaagacttatcaattatgtaatactacaagaaacggaaagtcacttgttgatgccgctggttctattattaatttaagaaatgataatagtaattatgataaaattaagagtgaattcccagaacaaaataatatcattactataagtaagaatgctgctattggtattggtattgatagtggtagaaatgaagctaccgaaagtatttataaaccaataaagacttgttattctattaaatcgaatgttgatgaaacaaaacaatgtcaattctcttcttcagatttaatagctgtcggtaattattgtataaagaatgatcaattgtatgtaacaacagaagaaaaaaaatgtcaaaaagttgataagaatactgctttattattaaatggtgaaattgaaattaaaagtgtagctgatataactttaactacaagaatgtattattgtaatggagaaaaatgtgaaattacagcaggatatatgaaattaggaaatgatgaagtaaaatgtgatttaactggatgtgttaaaaatgaaagtataacacacgattttactgatcctattacttattcatattcagaagacccatcagatttcccaggtgctgctaatgtgaaatcagcattaattgaaactggtagtaattataaagtattatttaagggagatggttattatttaattaacagttcgaaagaaatgttagataaagattcagaagaaaatccaaatttatcagcaaatgcaactggtaatttatatttatgtaataaaaatgatttaagttgtgtaatgcaaaatgatgatgatgcacaagataaaattaatggttatttcttaaatgggaaaacaaaggataatacatcaattattatttgtaaagatggtgtatgttcaattataaataattcgaatgctgataatattaatgatattcattatggaactgataaatgtaacagtacaattagtggtagtttggtcagagataataaaaagaatgtcaaattatgtatttctaatatagctcaatcattcacaactaatgattcagtaaagtattatgccattaaattgttaaagaacaatgcatttggtagtgttagagttacagaagaaaatgatgttgctaatattattgttaaagtaaccagcaagtcaatcacccaatacaaagataagggttatattttacataaatccacaaatgaaattgttgaaaatgttggaggtaataacagcgctagtctctacaattgcaaagaagatgatgataacagagttgtttgtgatgctgtaaagaatattaataatggatggtactttaatgaacattacaatgataaaagatatatagtttgcaattctggtgcttgtgatgtaaaggaagctccagaacttatgcaatgtcaatccagtggatcattaatttacaatgatggaaaattcaaattatgtaagacacaaaatgaacaagttgatcttgtcggaaattacaaggttattgtaaatatttcaggtaaagaaaaattcccatcaattgaaatgaataatactgaaattttgttagaaattaataataaaaactctgttactattgaaaagtttgaaggatataaaattattaatgaacaagataagaaattaattatagatgatgataaagaaggtttactctataaatgtgaatcaaccggagaatgtaatagagtattattaccaaaccaaaattattatttgaagaataacgccacaggatttgctgaagaattaatatattgtactggggaatatggatccaaatgtgaaattaaaaatccagaggaaggattttatgttggatctgatgttaacaaaccaatcattcaatgtatccaaccaggatatgaagttgatggaagtactaccacaactggaaatattgtatgtaaagaaagacaatttaaagaaggttggtttatgaatgctggttctgataagaatgaatatccacttatttattgtaattatgaacgtggttgtgttacaattaaagatttaaatgatggatggtatatcaatacaggaagagaatccatttttggctacgacggattgaataattctactataccatcaattattaaatgtgaaggtaattcttgtgattatgtaaaaagtaaagatttaaagagtgcctgtgaagaaaatggaggtgaaataattatttctaagggatcaataaaattatgtaaaaataataaagaatccattgatgtatctaaagcaagtaacaccaatatcattatgataagtgaaaatgaaaaattcccaggtcaatctggtagtgatattattgctgttgaaataaacaaattctcagcagttcaaaagaaatatgctgaagaaaccttcttatatattaacaaggaaatgtatagatgtgatgatacttgtgaaattattaaaggaaatgatgaaacaaatggaatgaaggtattagatcaatttacaagaaatatttatacttctagtttatgtgatgaaaattcatgtagttgggtaataaataaggatgaaggattaatatttttagatggaaattacaagttagttgaaggaattggtgaaggatttaatgatatttctcatttatttaagtgtaagaaatttgaaaagaatccaacctgttatgaattagattttaatgaaggttattacattaatcaatatcataaaattgatgaaaataagagtggtcaaaaattgtacatatatgatggagaatggaagatatttgatgatgaatataaggaaaaaccaacttgtacctatttgaattacaagcaaaattactgtactattagttacagtgatgaagtttattctgacagtgacaatgaaaatataatttcagctggtgaaatatgtaagtcaagcaatggaaagtatttcattgcctatggtgaaataaatactggtattgatagtccaaattgtgttagtttcccaaatgacgcaacagagagttattataaaattaatgaaaataaatatataatggataaatatggatttttcgtagttggtgattatgttgaaaagaccaactctaaattagtatgcaatggaatgaaatgtcaaattgaaaaaattttaagatgttcattcaatattcaaaatggtacatgtaaatctagttctgatattataaagacaggtaatatatgtatttcagaaggaaatacttatttagctcttagcgacatatctactagtgaaggtagttgtattaaatatgttagtccttctaatgaaaaaactattccatactcagaatatggatatgataatagtaaaattgtcaagggcgataataaaaataagtatttattgattaataataagttaagtatatttaactcacaagaaagtgtaatgttaaaatctgaaggaaattatgtaattgacaattataataatttagtaaatattggaaacaatgaaattagtatttctgaaaattcaatattcaagtatattttatgtgatggtaataaatgtgaaagaagaactacatgcttgaacaaaaatgaagctgaatatatctatgatagcaacgaaagtattattaaatgtgatccattaaagaaaactatacaaaagattagtcaacctggatattacttaaataaaccatggaataatttaataaaatgtcaccaaaatattgttaaatccaaaatagaatgcaaggtaataaatggaaataatggaaatgaaggttactacattaatgctggtaataaggataagattattaagtgtattagaaatgaaggtagattcagttgttctgaagaaaatattgttgaatgtacattagacgaaaagactaatacctgtacctctaaattagagttattgagaaacagttactgtatatacagagccgaagataagaaattaggaaagattgaaaagttaatgtatgttgaaaattacattaaggaaggtgaaaagggtagttgtatttctggaaatgatgttgatccatacttctattactctaaacaatctaaattcttgggtcatccagaacgtaaagatttaattagagtaagtggtagttctgtaacaagtatttatgaaaatgatatcggttattatgtaatagatacaaaggatggacttggtttgaaaaatgatgttggattagaaaaaagtagattctatgaatgtactaaggatggatgtatagaaaatgtaaatccagatgttaataaaatatacattaataaggcttcatcagaaaaattaataaaatataaaggatattgggatgtaattattgaaagtaaatgtactatatatgccaacaatccaaaattatgttatttaggtggcgaaggtataaataataaaggtatattgtatattgaaaatgatggaatgttaactttctatgttccaactgaaattagtgaaaaagttaatgctattaatagaaataaatttgatacaaaagataaagaattagaaaaaaatagatatattcattatgaaaataatttatacttattaaatagtaattcacaatcatttgataaacaagttaaagaaggttattatttctttagttctaaaaaaactaagtcatttaatttattaccatatgtaacaacagtgaataaaacattagaagatgaaaattcaaatgagatttcttactatgaggtaactaagaattgttatggagaaataaattcaagtgaaagtaaaagtattaatgatttaaaaaagggatgttattggaatagagcaaatgaaaatgttgttatccaaaatatggaaatttctgataaggtaaaaccagaagaagaagatgaagaaggtgataaaagaagaaaacgtaataatgatgtagaattaaactcagtagtaaaatcaaatacaaacatatgtaagagtgttgttaaaaacaattgtgttagtgcaattgaaggacaagtcatttcaaagggtgatgtttgcttagtaaaggatggtgaatttaaaggattgtatttaattataaatgatattaagaagggatcaagtggaacaaattgtttaagatatgattatggcaatgtttatcactatgtcaatgaaaaaactaatattaatggaaaggattatgaaaagatattagttaaaattggtaaagatgaaattgtaccatttgatactaaacttgaagataatagtaatgtaggttattatgtgcttaatagtaataagcaaatgatatcaaatgaaagtttagaatcagctacagcttataattgtaattataaatatgatgaagaaaatgttaatatagaaggatttgaatgtaattcatttgaggaaaaaggaaataaatattattatggtaattatgaaaatattttgtatgccagcaatagaaagtggaaagttgaaaaggatgaaaagtattacttccgtaatgatgaaaatttagcatcatcatatgatgaagaaagtcaaaacgaagatacatgtaaaccaataaaacttggaaatattgaatataatattgaaggttattatttgaatagtgctgaattaaatagaactgtattagttgaaaataagagtgaagattattcaatttataaaggattaattaaatgtaaggtattagaaaatggtcaatgtagtagtgaagaagaaggaaaacaactagttactggagatatttgttatgacggttcaaagaagaaattatatgttgttgaaattgaaaaatctcaagatgaaaatacgaacgatattactaaatgttacactggaagtaggaatcttaaatataagattattgataacgttttataccaattggatggattatctttaaagaaaatggcaagtggtatttatatattaaatgataaattagaaaagtttgaaagtgaatatcctgaaaagccataccaaattgtttcctgtgaaaatggtggttgtgaaataaaggataaattgcaattagaaagtaatgaaattgtattgaatagtgctgttgtatatgagggtagtaaggaaagtatattaaaatattataatgaaactataggagaaggtaatgagaaattcatgaatcttaaagataataataaatgttattgtttagataaaaacggtgaaataccaaatgaagattcagattcatgttattattttgttaattgtaaaacagatagttacaatataaattatgcaataaatagtaatgaacgtatgatattaaaatatgaaagtggttattataaattaaatactggagaatatgataataaaaaaattaaatatgatcctaaattggatgttataaagcacggaaatgattacaatattgatgaaaatgaaattaaatataagattgataataacaatatatttaaattaaaaccaaaatatataacttatggatatggaattattgatggtttgtacttattaaaggatggaaaaccatttgaaagtgaggaatggacaacattgactgaaaaagaggtatgttatgctgtaaagggtagttgtaataaatcaaaattgaagacctatagagaaaacaaatatgtaatcaataaggctgttggtaagacatcaattgtaacttatgatttagaaaacaatttatggagaactgtaaaagaagatggatattacttcttatttgatcataatggtgagacatactctatcaatattgaagatagaagaccaagtaaaatatatgaaattagaaatggtgaattgattgaggaaaacttagttaataaagaaggtgaaatcggtttctacttatttaatgatttaattgttgaaaaggtaggaatgggatgggaagatgcaaagaaaatattaaataatgttgatgttgtagaaaagagtaattgtaatgctattgaaaaggctgaaataattgaagcggatgaatattgttacaatgaaaattacggtatgtgtattgttaaatctttaattgacgataagactggcaagaacagtaattgtgtatttaacactaatgcttcaaaacatttcgaagttattaacaatgaattatacttaattgatgctaactcatttagaaagatcacttcatctggaatatatgttattggaaatgataaattaggttacaacggaaagaaggaaggaagtgctagcgcctataaatgtgttgatggtaaatgtactattgctaatgatttagaatctcaatattactacaacaaggctagtgaattattaggtgaagaagttattttataccatgataatgcaagagattcatggagaaagaccagtgaaagtggaaagtatgtctttaataataaaggatacccaactgtttcttcagaagaaggaatgaaggtatatgaagttggtaagaaaggttcaaagattgaaaaggttgagagtgctagtgatggtaaattaattgttaaaactatttcaaatgaattatttgttatcgatgttaagaatggtaaaattgaacttaagcgtatgaaaaagtgtagtgtcgatgttaatggtaatgttaaggttaaaggaaaattacaagttggtgatctttgtaatgctgatggaaatgttgttatcattactgctaacaagaatgcaaaacgtgaagaagttgaagatgatgaagaagttgaatactcttacactggagctgtcagtgataatcaagaatcaaagatgatttacattgaagaagaaatgaaattcgcagaattaagtaatgaaggatatgaataccttgatattgaaggatatgttgttcttgacaaatccaatggtggattattagaaagtacaactgaagttttatgtgatgcctacttatgtaaggatggaaaatgtaccttattagcagctgataaaataaagagtggaaactattacataaatagtttaagtgaaaatggaaaacttgttaaatacgtaagcaatggtaagtggaaggttgaaagtgaaatcggatactacttcttaacttctgatatgaagatggttgaaaaggaaggtgtaccagaatacgtcattgatgttagaaaggttaatggtaaaatggaacaagttgaaattactgatgaaaatgttgttggtttctacttaaacaaggctggtaagaataagtacttagtgtctaacaacgaagtcttctggtctaagggaactgaattacgtatttgtgaaattgaagaaaaggaagaaggtagtatttgtaaaactacaaaagaaaatgaagaatatgaagaaggactttactgtgctagcaagggaagtaatgtattatatttattaactggaaaggctacttctactcaaaacacagttaattgtattagtagaaaggatgaagataaatatatatcatccaagaagattactaaaatgaatggtattgaattaaagaacaaattgattgaatttaataaaaatgctattacacttgtaagagatggttactatataattagtcaaaatgatactttaatttctagtgatattgctaacaatgaagatgttgaatttattatttacaactgtaaagataccgtttgcagtaccaatgttagtccaggtgaaaagttaatcactaacgaaggtgaaatcattgaaattgatgaagaaggtaaattagtttccttaaccgaaaatggtctttccttcttcagtaaggaaggtaaggtttgtgatgaaagtgaaagtgaagttggtatcattattaatgtttctgaaaatggaaaggtaaacgaatctataggattaagtgacttacaagaaggtgtatacattaatgaaagtaacgaagatgttgttgctgtgaaggaaaatggtgaatggatgattaaatctgttaaatgtagttatgatgaaagtaagggtacttgcagtaatgaaaaggttgaatttgcagttggtgattactgtagttatgaaaagaaattatacgttatcaccgaaactgttgaagatgaagaaagtaagtgtgttgttggtggaaaggaaagtccaatcataatgaagagtagtaatggtaaattaatttctgttgaagagaagatgattcaattcatcgaagatgatggttactacgcccttagtactgatgatactccatttgaaaatgtagaaatggctgaaagtaagttaattaaatgtgaagatgatgaatgtaatgaagttgatgttgaggttggtagttaccttaacaaggctcctattgttagtaatattgttcaatacccaagtggtaaattggaagaatctgtcaagtccgataagaaatgtgaaattaatgaagaaggtattgttagtggtgaagatgtcaatgttggtgatgtttgtattgtatctcaatctctctacttggttggtgatgatatgagaggaaatgaagttaagaaggaaattataagttacaaattggttgaaaattcattatataaattgaatgatgatgctgttgtacaaatatttgatggttattactttgttactggagaagacttaccagttactaatgtaaaggattatgcaaaggttgatactgttggtgttatgtgtagtagcaagggttactgtttcgttatggaaccaagtattttaggttactatccagattacaccactaagaatggtaaaaactttagaattattaagtataatccaagtgataagagtggaaagcgtgaagaagaaagtagtggttatgaagtactctccgaagaaggtatttataagatggatgatggatcatatgctcaatgtgaaaaggataataatgatgaagttgtttgtcatgatattgaagaaaagggtgcttatgtgactgttgatgatgaagttattgtttgtgttgaagatgaagatgaagaagttcaatgtagtcaagctacaaatggtggttactactggattgacaaaaagttatatgaatgtgatccaagtgaagatggtgataagttagattgtaaagaagtagctaaggaaggatactttatttcccaaccagaaggtgatctttacgaatgtgaaaaggttgaagaagaaactgaaattgttgaagaagaaaccgcagatgttagtaagatatatgatggattaaatgctggaggtgaagaatcaagtgaagaagaagatgaaactacaaccaccacctctaccgaagaaagtacaacaactacaactacaactgaagaatcaactacaacaacaactacaactactgaaattggtattatatataatagcaaatgcaaaataaataaaaaatattatttaaaaatatataataa

SEQ ID NO: 27329 - DNA, 18571 bp, Neocallimastix californiae
  ScaA scaffoldin- CDNA Sequence
tatttattattatataataattattattacataaaattatatttatggaaaacctattactataggtgtaactataggatcaaaagatacgtcaaaaccattctacttgattgatgaaagtaatagtattgttgaaaatacctctaataataataaaattattcaaataaattcaagcggaaatacacaaattgaacatgctggtgtaggttattttcttaatgctgatgttaatactaatgaaaactacccattgattctttgtgaagcggataataattgtgcattaagtacggttgaagcaccaggatattacgttaatattgatgataacacaccaagcgcgtcttctatagtatgtaccacaacaaaaattgtatagcatatacaccatgtagtgatgtcggatgtattactatatcaggaagtacagttaatcttaaaggttcaattgattatcctatggacagaaatgatggagttgataagcaatatttattatatgatgttgaaccttcaaaattcccaggggtaacagttgcaggtaactatgccgttcaaatgaaaattgccaagaaagaaagtaatgataaagggtatggtaccgttactcttaatgaattaaaaaccacatgtactgatacaccagataatgaaattataaaacataatggaaatttctattattgtgctggtggaattgaagttgaaatgaaagatagtggagcaagatttgctatttcaattaatggtgaatataaaattatcgatattatgaaaaccgctgctattgaaaaagattctactcttgttgatgcttatcttggttattacgttgacagaagttctggagcgtctggcgttgttcattgtgaaaaaaaagatgctgatggtgcggaacatccctcggattatatggaatgtgcagctaaaacggttgattatgttgataactatgaagtctttgttaataaggaattacgtttcccaggtagtaatggttcagaactcaatgctaaattgattatttgtagtaacgatgaaggtaattgtaaggttccagaggataatggtggctatcataatccatatataaaagaaaaggaattaatgggaaatagattctatattaatcatcaaaacagtgaaaaaactcttatttattgtagttctatgacatattgttttgaaatgagtagttccagtaatccagaacttgttaaaggaatatatattaatggtgttgaagatttagccctcattaaatgtgtagaagataaaactacaaataatgatggtgaagaggaaattaaaattgtttgtgattcaatggctagtgtagaaaaatacggttactatgtaaattacagaaacgatactacaattagatgtgatcttgaatcatgcatcttaatcagttatgataatcataaacgaacatttattaacagtgatagtgaaagtgattatagaattattaaatgtcaaaatggaaatgagtgtaaagtagttgaaaaatcccaaaattattatatagatagcagttcaaattccaatgctttaataaaatgtagtacttctgataatacttgtactaaggtaactggtggaaatcgtgatgtatatatttctggtgatggtgaggatgtaattatttgtaccactaattcatgtaattatcaaaatagtgaagcaactagtgctgatgtagatcaaacatattatttaaatgctgattcgtctgctgaaattccgctgattacagccgttgaagttaaagaaacggcagtcacacgaaaaaaaagagatcaaacatataaatggagtgcccctgaagaaaaaccaaaatccaatagtgtatttattaataaaaatgcaatatctgaaaaatatggtattatttattgtacatccgaaactcaatgtaacgaaatagaaacattcgataccgaatatatagatattattactcctaaagttatatatttcgacggattaaataatgaatggaaacaaaacattaattatttaacttctaactctttagattcaacttatattttccttgttaataaattaaatgctgaaattattaaaactggaggatccaattcttcattagtgagttgtaaaaaagaaaacaatgcttggtcatgtgaatatttaacttcaggaattcttaattattatgtatataagtattcaggtgataaattaattacctatagtaataacgactttactatttccagtacaatggataatggatattatttaaatagtgaaaacataataaaatgcacatcagatacatgtgcaatttacttaggagttgaaagttgtacaccagaaaatgttggtgctataatatccaccagtaatgaattatgtgtaggatatgattcgactgcaaccaatgaaaacgataaaccaaaaacagtatctatcaacgataatcaaaagtatttaattgattcaaaaaaattccccggctattcaaatgttattagtaatggctcaatattgattaatgttagtgataataaaattttacaagtaaaaccaaataatgatgaatattaccttatatcctctgactataccatcattggagcagctgataccgaaggtacagtgtataaatgtgaaaaagcttcaggatctaatccaccaatttgtacaaaacagagtcaaacagacacgaagtattatccaaattcagatagttcatcaatgaagaattaccctaacattaaatgtgaaaagataaaggacgaagaaaacagtacagaaactgtcacaaaatacaaaattccttgtacactctcaagaaagagtggtgatgaagtctattgtttgaaagccaataacaataacagacttagttcctgtatcggaaattgtggagttaatgcaacctgttatgatataactaacactataggatactatcttccataccaaaagagcaatttaattgaatgtagtagtaattgtaagaactatacagtctctgcaggatattatgctagtgcagatatttcaaagtcactcatactatgtaaaaagtcggtagacggttttcgttgtgactatgaagatgatgtgaatgatggatatttcattggagaaaaaagtagtagccttgttaaatgtaaagataatgtatgttcgaaagttacgattaatgcaagcaatttaggatattatgttagtggtgaaagtggtaatgcattaattaattgtatatcagaaaataatgttattaaatgtgttgccgattctaaaccagtattaggatggtatttaaatgcagctgtatctggaaatagttcaaatgagaaatatttgatcaaatgtgtttcggataatagcggtaaaattacttgtaaagaaatggaagtaccgaataaaggctttttcattagtgctttcgattcatcaaaattaattaattgcgaagactcaagttgcagtagcataaatttatataatggatattacgttaacggagaaacaaatcaattaatttattgcattaataatgtatgcactgaagaaaacggaaaaggatggtataaaagcatttattatgataatgtaatatactgcaataatggttgtaagaagctggacgtaaataatattaataaaaatggatactacattaattcagatagtagatctcctaaatatccgttattagaaattagatattcaaatttaatatatgaaaaaagtaactattataatggatggtatttgaatgcagatactaatgatagtaatatgataatcgaatgtaattcaaacggtattgttccaatttgtaatggaaagacacttggaagtggtacagattgttcttcaagtaataatggcaaatttattaatgataacggtgaaattaagtggtgtattaatgaagaaaaagtgaatttagtttctaatggaccaacagtaattgctaaaattactggtcgtaattttataccatggatatccgatgcaagcggctttgttattttttccgtgggtagtaaattcataatacaaaaaaagattgatggttactattatgacgataaaaatagtgaactttactattgtagtggtagtggttcaggaatttgtaataaaattgaaaaaggtaatattacaccaggatattatataaattataccgaaaagacaattattagatgtggtagatatgatgataaactatgtgaaacgtttagttcaggattatcttgtacagaatataatgttgcctttcgcagtaatgatattgtattatgtacaaatggaggctatgtcactatggaaaatataaatatcgaaaatatctacgcattagatattaaatataaaagtggaaatccaactttcccaaagaagagtgatagtaaatacacaagatatatattggcggatgttaataagtattatgtaaaatataatgaagctattgaagaagtttcggaatgtcctgaaaattcaaataccgatgaaaagaatgataaaatagtgtgtatgacgactggtactaatcctaaattagttcaagttaacaaccttgataagactattggattatcaagtagcaccatttattatgtaagtaaaaatgatgaattaaagaatattgaatatgacgcagatacaaataatggatactttgaatataagggaaatgacctatcaaactcaaatatattgagtacagtgtatatcaagaaaaccgataaaaataaagttgaatttaaatatgtttgtccaatcggtggaatatgtgttaggaaagaaaaagctgaggaaccggtacttggtttccaatttgaaaatggtattttaaagatgcaaaaaagaaacggtaaatcaaatgaagtcactgaaaaaattatgcctggtatatatattaaatatgatggaacgagcacgaatagaaatgaagttattaattgctatcttacttcaaatggagttaaatgtgagaatattaataagacttcatctggaatttcctatgatggtaaaaatattagtgccgatggtgttaccagtaacaaattattctcgaaatttgttataaagaagtcagtaaataagagagacaataataatgaaagtaatgttctaataattaaagaattaacagcaacgtcttataatgaggcagaatttacatcaacaactaatattttcttaaatggcgaccttaaaaagattacaaatgatatcattgccactcaagatgaaacaaaagtcacaggttacatttgtaacaatattggtgaatgtaaaaagatagaaaattctggaaataaaaagtatttacttaacactgctcaagagggaagtataataaatgcagtagtagtctgtggtaatcatggaactgaaggtgataaatgtaagtttattaatgctcaagagggagctatttatgaaaattacgcagccactggtgtaaatgatgctttaattacatgtacttcttctggatgtaaaacggaaccagccttatcatcaggtgaattaccacaatgcgaatatagttcattaactagagatattgtaaaagatgaatttggtagttgtattcgtgctgatacacaaaaatcattaggtgttaatcaacattgtatacttaatggattaatttatatgtatgatggtagtgtctgtagtactattataagaagtgaaacaattggtatgaaattattcgatgcaacattaagagaattaactatttctaagattgtagaaaatcactatggtgcaacattatataattgtccaagatcaaatggaggatgctatgtaacatctggttatattgcaagtacagcacaaagtgcagcaggatattccatatgtaatagtaagaatggttgtacttatatttcatcgtctgaattaacaaactcatgttcggaagcaggagaaggaggcttaattttagataataagtatattaaattatgcaaaaatggtggaagggatataagtactaataccgctggttattatcctgttaatataagtgttaatgataatttcccagatagtaaatttggcgataaattattaattaatgtcgatataaataataatatggctgtttattctatggtattaactgatggttatcttctactagatatcaatagtaaaattcttaggggtgaagcattagcaattagtagtggtaatatttatccttctactactccatgtactatggataaatgttcattatatatttgtgaaagcgacaatagaaaatgcgaaattgtagcagaagcagaaaaacaatatggttattatacctctacttcctattctaaagatttaataacatgcactaaaaatgcaagtaaaaatttagttgaatgtaaattaactagagatgccatatattttgtaaatattattgacagaaatattattgacactattattaaagatagtataaattcagcgtccatttcattcagttcaaatgataataataaatatttctcaatcactacaggattcccaggattcagtgatagtaccgcttcaaatgcagttaaacttagtattattgctgaagctaaaaagtatagtattactcctttgaagactgataattacgtattattaaatagttacgaaaacagattagcgattaaaactgaaagtcgtgaaataaaaaatatttatctctgtaattcttcagtaggaaaatgtgtgaaaaatgatgttgaagatggatggtatattagtggacaaagtggttacgaaggaatacgttgtgagaatggaagttgcgtcatgaaagaaactttaaataaatcatgtagtggtgaaggtgactttatcattaaggaaaatgtatatcaatactgtgtaattaaaaacaaaagtattacttctattaaaattacagaaaatgtaggtaaaatattacaattgactagtaaggataaaaaattagtattccccaataataaaacatttactgttgtatatagtaattcggttaagggtattggttacagtagtagtgaaagtgtagatacaccaaatggtctcactctctgtactaccgttaatacatctggaaatggaaattgtgtaaaggaaaatggaaatcaattacttagtggagagtactgtttgtacggaactaagatttattctaacgtaacagaagcttctgtttcaaaatgtaagcaacagttcacagagggagtttctgtagaagtattttatggaactaagaaagcaagtgctacagaaatagagaatcctggtactcaaatgttctactgtaaaaatggagaatgtagagtaactacaggatacaaaaagataagtagttattacagatgtgattactccaaatgtacgaagacaaatggaagtaccggatatgaaaatggtgatttaaaatcaagtaaattagttactgctgatggtgaaaaatccttcgctaaggatacatacttctatattaacggaagtaacaatttcccaggaactgaaacttatcagtcatttattgttgaagttggtgcggattacgctgtaccatttattggaaatggatattacttattcagtagtgctggtgcaatgttaacgaaggatccaaaggaagaaggatatgtcactactgcaaagacaggtaataagttgtatctttgtagtaataccgacaataattgtgttcttcaacaaaataccaataatataatagaaaatatattctattcaaatgctggaataagcgattctaaaaagaagagtattattggatgttataacacaggtgataagaaaagtaactgtgtaatcgccgaagatgctgtaatatttgaagaaacatataataaatgtgaatttactggaaagttggttcgtactacatcgaaagctgatagtgaaggtaaagtaacttatggagactataaattgtgtacagcaagaaacggaacccctgttgctataggagatgctgctggaaaaccaaagtattatatgttgaatatgaaaaagaatgatacttttgcaggtattgacttaacaggtgataaggttgatgagaattacagcagaaacattttaattgaaattactgataataaattaagccaatatgaaaaagaaggatatattctttacaatgcttccgcaaatgaaataattgatagtgttggaagtactaaaggagtactttattattgtgctaggtcagagaatttcaaaggagctggtaaatattcctatgaatgtaaagttgaaagtaatataaataatggctggtactttaatagcctttacactcaagacaaacgtttgataaagtgtgttgatggagtttgctacttatctgaaataaaggaaagtaataaatgtcaatacagtggatctattatttacaatggaggatttaagatatgccaaacaactgataaattaattgatatttctagtattaataataaaaataccgtagaaattataatgaatatcgaaatgatgactgaattcccaggaatgaaaactaaccatactgatattttgttatccataatgccaaataaggcatatcaagttaaacttaagactaatgtagttgtaagagaagataatactattgtttcaggagtaaaaggtgatttatatgaatgtagtgtggatggtagttgtttaatgaatgttgtaccaaaagataactattatattaagagtaatagtactggatatgacgtagaattggtcaaatgtgaaaatcgtaaatgtattgttgtaaaagacgagttggggaaaggaaaaggaattaaggaaggattccgcgttggtgttaataagaaaactccattaattcaatgtactcaaaatggaattcaggttgaagataaaaagttcattcaatatgatatttcaacttgtgttgagaaggagtataaggaaggatggtatattaactctggaagcgatagtgacacaaagccgttgattgaatgtactaaagaatctggatgtatcactaaaaaaccaactaaagatggatggtatttgaatgctggagctaataatatttattcagttatgactaaaaataactctaccgtttatcccatcattcgttgtgaaggtggaaattgtaattactacaaggaagaattagctaaagagtgtaccaagggaggtgaagttataatgccatccaatggtaattataaggtttgtaaatctgtaggtaaaagtcttgatttcagtaaatctaatactgttgaattaattaataacgaaggtaatttcccaggtagttctggaaatattatggtagtaccaagttcaactaatattgtaattgctaatgatggatattattacaaagataccttatacgaatgtcgtggtagctgcacagcttataatactgatgataaggatggaaagatgtattatgatgaaattagtggaaacttaatggttggaagctgtaatggaggtatatgttcctggacagcaaataaaattgaaggaaacgtattcttagatgacagaaatattttggttactaaccaaagcaatagtgttagtaaaatatatgaatgtactaaaaatgcaaataagattcttacatgtatagaagtattagaaaataatagtagaggttactttattaataatgaaataaaagatgaaaatggtaagtcacaatctctaatttacttatgcacaggaaatgattgtcaagtagtagatacaataccaaaatgtaccgagttaagttataaaaagaattattgttatattagttactacgatgaaccaaactctgaagattatgtatccagtgaaccagtaataaatgctggagaaatttgcgtatctaacattaatactaattcccagaagtactatttcgccattaaggagataaatactggtacagatcaaattaactgtattagtatgccatcagatgctagtgaaagttattatcaagttggaaatgtcatatattcccaaaataaatacaatgtaagaagaattaattatagttactctttaattaatggattagatagtaattcggtaattaaggattctactataactaatgaaatcaacggaatactagttgaagatcatgaaaactttgttaactgctccagtggtaaatgtgaagttaataaaatgttaagttgtacttacaatttccaaactgaaaaatgtagtatcagtagtggaaatgttaatgctggtcaaatttgcaagtctgctgaaggaaatatatactttgctttagaaaaattatcaagtaatggaggaagatgtgttaatcatagcactagctggagttactctgaaggtagtgacacagtttatccaaattattctaatggacaaaatgttagtaacgaaaaatatgaaaacacgtatttcgttgttgattctaagatatatatgattgaatatgataatgatatttacgccttgggagagggtatttacataattgatgaagctaataaaagggtaaacatatataaagaggttgatatttctaaagaatcaaagtttactatgtatgtttgtactagtgcaggatgtaaagttaagaacaattgtgcgtcaggtattaattacgaatatatgttcgacaggagtactggcactgttattagttgtgatccaaagtctaataaagtcaaaaatatttattctgatggatactatcttaacggaccatgggaaaatttaataaaatgtactaacggcaactgtgtaaactacgataataagattggtagagaaggttattatcttgatcaaggaaatcaagaaaaaataattaaatgtattcgtgaagacgaaaaattcaaatgtacattggaagatgccattcaatgtacatataattctaaagaaggtgtctgcgcaagtactgtagaccttttaagaaatagttattgtctttatgttgtgaaagataagaagggagtcataattggaactccaaagatgttatatatagaaaattacattaaagccaaagatattggtaaatgtattagtaatgaaggagaagatacattctattatcattaccgaaagtcgaagttcttaggtaataacgaaagagatgaaataatacaatattcaagaaacgctatttccaatatctacgaaaaagaatatggctattatattattagtactgaaaatagaaaaggacttactgaagacacaaaattaaatagatctagattgtatgaatgtacttcctccggatgtatagaaattcgggatcctattgatgagcgtatatacgtaaataaggcttctatggaaaagatggttcgctataatggtaaaagtaagacatgggaaatattaaagcgtcgttgcaaacagaacaaagtaaatacagctcaatgcgagttgccagcctctaactttaagagtggtgatattttatatatgttcgaagacggagatattaatccagtctttaaggcttcaaagtacgatttaaatacaaagaatactttaattgacgataataatgattttgttgatccaaagaaataccaatatttcaatactgaaggaaaaatgtatgtatttaacaaaaacaaacagtactttgatattgttgatgaagaaggatattacatgttcaagacctcaacatactatcacaatttagaaccatatagaagtacagtaaatactactaatacagctgctttaaaggtgtatcgtaaaagtgataagtggtatccaatggaagaatttggtaatacctacactgaaggatattatcttaataaagccgatattgaaggtgatggaattgccattgaagtaatgaatataccattaaaatctgatgatattgatggtgaaagtgaggaagaaaagaagatcagagaacaaaatagtaaagtaaagaaatttaaggcggttattaataaatgtaccagcactaaaaagaatatctgtaatccaaaaatagaaggacaaagcattaataaaggaagtgtttgtgttgttactgaaggtgatagtaaaggactatatcttgcaattgataacattacaaaagcatcatctgcagtcaattgtatcagatacgatggagaaaatacttatcacttcattaataataatgttatatacgccagtcaaccaagggaaaaattaatcattgaagtacaaaaaaataagattattccatttacaagtgaaaccaatatgggctattacattattgaaaagaatgagaagaaattattgaactcaaacaatgctattgatgctaatgcctacaattgtggatggtattatgacctattcactgaaggtgaaaaagcaggagaagaaaacccagaaacaaagagatatgaatgtaactcagaaacaatttacaatcgttacattcgtagtaagaatggtgatgtcatatttggaaagtctacaacaaagtggtataaggaaagtaagaagggatactatttcttcaatgataagtatttagctgcaactattactaaagatgaagacgataaggatgtgcctgatactattacatacagcaataatgtaagtaatagtggtacatatcttaatagtgccttaataggaaataagaatattattgtagaaaatgacaatggtaagcaaaccatcaagacggaatacaagacttgtgttgtttccggagaatcttgtaggtcctccgttactactaatgagttatctaacggagaagtttgtcttggtagttccaaaaataatttatatattgttgaagttattgagcaagatgatggtacaaagaagagattctgttacactggtagtgataaattaaagtatagatatgttaataatatgttatacagattagatggattgtcagtgcaagaagttagcagaggttattatgtattaaacaagaattgggaagaatacagtagtacttatcctgaagttccaaatgccatattctattgtgatggaagatgtgaaaagataacaagcgttgaaattgattccgaagtattgatcaatgaagcaggaactggaaataacaagctattgagatatttcccagctaccggtaagctagttaatgtatatgaaccaggctattatttattgaatagtaagagtggagttactaaggaatctggagcaaatgattacaatggcaatatgtactacttgaatgataatggcgttttatcaactattccaaattcatttggatatagcaatatatatattaataaggccaaaactggttcactaactagattctattctgaatttgaaaattcaaaggtttcatacaatgttaagactggacttctcgaatatgaaggaaaggcaaatgatggggatgaaatcgttttagtatatattgatggtttattatacaaacaattaccttattcctttgaagttgtggaggaaggtgtatatgctattaaagataatttaccattcacggaaactgtatggactgaattgaattctagtaataatgaaatttgttactataagaatggttcatgtaatgatgctaagttaaatgaaattatgaagcaaaaatacaccattaataatgctactaaaaatccatctgtcattgaacacggtgaaaatggatggagaatggtaaatactgatggtgtttacttcttctttgaagacggatattctatcactactactgaccgtagaattgaccgtgtgtttgaagtattagatggacaatctgtagaaattacagaggacgaaaatagattaggttattatcaatttaatggaattatgattgaaagtaacactgaaaaaggatgggaagatggtgtagtgtatattgaaaccgttgaacaagaagataagagaaagtgcacctcttatgaatttggtgaaatcattggaaatgataaattctgtttcaataatgatttaggtatttgtcttccaaagactgatatttctaatgaaagtgttaatataaacaattgtatatttagtagtgatggtgctgtttactacttccttattgatgataaactttatagcataagtggacaggctatgaagctcatcaaaaagtctggtttatacattgttaatagtagtaagaagatttatgaggataaattagaaaacaaggctacagcttatgcctgtgaaaatggaaagtgtgaagtggctactagcttatctacaggatattatttgaatatggccaatggagctattgaagagccagctattctttattatgataattctagtaagacatggcgtatgactacaaataatggattctatttctttaatagtaatggatatgctgtaagtgataatgaagttgtaaaatacgcatttgccatatcagaaaatggaaatgaaattgacaatattataaatgctactgaggtaggtatatatatcaaccaaagtagtggagacgagagtatcatagttgaaaacaaaggaaaatgggaaaaagctaagaagattccatcttgtaaaatttcatctgatggagttgttaaatcttctgaactaatgaaagtaggtgatatctgtctcgatgaaaagaaattagtcttcattagtggatccagcaatggatcaaagagagaagaagaatacagttatgaaggtgttactgccgttgacgatgaaatcaaatacagctatgactctactaacaatgctattgttaaattggaagaaggaaacatggtaaaattaaatgtatctggatatgtcataatagaaaagggtacctcattaccaattgaaaaattgtctgaagctaatgtttataaatgtagcagtggaaagtgtgatgttgtagatatgcaaaatgtcgaagctggaactctttatgtaaattctatttctgaggaaacacctcttgtgaagtacgaaggtgaaggacaatggaatattgtcaccgaagaaggatactacttcttcgatagcgattctatagctgtaaaagaaaatgccattgttggaagtgccatagaaattaccgttgatggtaatgagcaaatagtccaacgtgatattagtgcctctaaggagttaggtttctatttcaataaagcaagcaataataaagttttaataagtaatgatgaagacttttggtctaaaggaacatccctccatacctgtaatattgttgaagttgaaggtggattcagctgtaaaacattgaaggatactcttgatgttggtgactactgttatgatggagaaaaattcttcttattaattggtgaagctgccccagatacagaagaaatcaactgtattgctggtagtaatgatgaaccattatatgttactccagatgttgtaaaaactattaatagtattgatgttggaagtaagttagtacgtttgaatgatgatagtattaaggtagtttctcctggttattacatcttgaatgtcaatggtactctcattgataataatggcgaaaagggagaggttcaaatgacgatttacaaatgtgatgaaaacgattgtgaaaaggaggaagaaatggaaaagaatgtaaagttcttgactgaatcgggagaaatatttgaaattgatgaagaaggtgtacttggcaaggttaataatgaaggtatatacttcttcaatgaagaaggtaaggcctgtagtacagctgatgatgaagttagtactataattagaattaacaacgaaggattaaaacaaaaggttgatttggatgaaatgagtgttggtacctatattaataatgctaataaccaatctgttggtgtatacgatggaaaggaatggaccattgaagaaagtgaatgtaagtatgatgctgaaaagaagagttgctcctctgaaagtaagaacttggaagtaggaagttactgtgttgttgaaggaaatatttatgtagtaagcgaaattgacatcgaaactgaattgactatctgtattccaggtaatgacgatgttccaatttactacatgaacgatgacacacttgtagctatcaagaataagagtattagcgttatagaaaatgatggatattacgcaattaatattaagaccagagaaggaattaagtctgaaataccagttcaaggtgttttcattagatgtgaatctaatggtgaatgctctagtgtaaaaccagaaaagaatagtagttatcttaataaggccgtggttgatagcaacattgtgaaattcaatgaaaaggctagtcttaaacaaataaaaacaattgaaactcattgtaagatcgatggtaattcatgtagtgctgatgaaggtgaattagttgctggagatctctgtgtagctgatagtaacctctaccttgtgaagggagaaggacaatgtgttatggctgaaaagtttgttgaacgttaccaattcgttagtaacaaaatttatatgctaggagaagatattgttgtacaaaagtttgatggttactactttataaatagtgacaatcgtgtcattggaagtgttgaagactatgctaatccggatactgttgcatacatgtgtagtactaagggtgattgttacattgttgatcctgtagaggttcgttacttcaaggattacaccactgaggttgacggtaaattcaaggtagtaagatttgatccttcgaagaagactaaacgtcaagaacaaggtagtagtggatatgaagctataactgaaggaggtatctacaaattggatgatggtagctacgtcgaatgcgaagttgaaaataacgatgatgtaaactgtaaagatattgaaaatatcggaaccaaggaaaccattgatggtgaattgcttacctgtactaagaatgacgataatgaggttgaatgtgtccaagccacagaaggcggttactatttcattggtgataccttaaaagaatgtagctctatcgatggtgtaaaattagaatgtactgaagttaagaaagagggttacttccttgctgataataagagtgaactctatgaatgtaacaagaaggttgaagaagatgaagaaatggtagatatcagtagaattttgaatgacttactgggtataactgaaaataatgaaagtactgaaattattgaagaattaaatggtgaaaacgaagaaatagaaatcgtaaataaaaaacgtgaaggtgagaataccgaagaaggagaccaagtagaagaaaatgaaaatgataatgctgaaaacggtgaaaatgatgaagaacaaaaagaagaaggtgaaaatgaagacgaagaaaaatcaattggaccagttgaagttacatgtaaggtcattgaatgtacagatggtgctactgttaacagtccaggagaaaatggtgaagaactctatgtctgcaagaagattgagaaacctgaaaaagaagaaacaaatgataatgaaaatgatgaagaaaaagaaggtgaagagaaagaagaagacatcgaagaagaaatcaatagatggatagtaaatgaaaaatgcatgagtggtaactacattaagataagtgatactactgttgaatgtgaagatccaaaagatagcataaaggaagaaaacattgagaaaccaaatgaatctcatatctcaactgaaagaaaagaaccaaagactaccacaacaaaaagtagcacatatactactacatatactactacaacagaagttgaagaagcaactacaacaagtagttcatctccatctaaatcaaataccaccaccaaaaaagcaactagcgctaaacctagaaacacaacaactacaaaagctgttgaaaccactacgacaaaaacaaccactacaacgactaaacctgctgctactactacaacagcaactggtggaactgttaaaatgagacctattccttcaatggtattgtactttgtattgcttgtgtttgcctatctacttcatcattaaatgaatataaaagaaatataaaaatgtttattttttatcctttttatttttattttaattaattattatcaaatatttatataatataccataagtataatatttttatcaatagatgtagtctttattttatatataaaaaaaagtaaaatatgataaagtttaaaatatatcatttaaaatatataacttatatatatatatatacctaattaaatattataccaaaaatttgaaattagtaattatagttattgcttattaatgagttgtatataataataatttattaattatttattaatattttaaaaaagaattaaaagattaacaattaaagaattaaaatttgaaaataattttgaaaaatataatagtaataaatatttaattttaaatgattattatcaaaagagaatatattgcctacatatttaaaaagtatgtaaaaattttatttaatattaaaattatatatataataacaatagtaaattggtattatatataatagcaaatgcaaaataaataaaaaatattatttaaaaatatataataa

SEQ ID NO: 27330 - DNA, 19137 bp, Anaeromyces robustus
  ScaA scaffoldin- CDNA Sequence
ggaattaaagaaagagaaaagaaaataaaagaaaaaacttcttttcatcattgtaaaaagaatttttttcaaaaaaaaaaaaataagttaaatataaaaaaagaactttgtaaataaaaaaagtaattaataattttttgtaatttaattgtgaatatcttttgtttttctttttttgtaaataaaatataaaagcaagtggaaattatttttgattgtttatttatttatttattaaaacttttacataaataaaatacaaaattaaacaaaatttcctttaaaaaccttttaagtaatataccaaaaaggaaattatggttaattttaaatatttaagcctgcccttactggtaggtcttattaataatttcgttagaggagcagaagtagttgttcgtacatgtagttttgaaaaagatggtaatgattatggaaaatataaactcgtgactgatgataaagcaacacccccagtgacacaaccaaattgtgttacaggattttatttattgggtgatgatttaacaacagttgttgctacaggaaaaacaggaaaattgtattattttgacaaaacaacatcaagtaattctagattatttaataatcctgtaccaggttattataaacacgcttataaagacgatactaatgatattgttgaatttatatcctgtaatgccaatggtgaatgtaaatttatgggtgaattaacagaatctacttgtaatgatagtaaagctggtagtctttataaatttttagacacttctagtaccaaatcaagatctgatcctgttcctgaatatagattatgtttaggtgcttttaaatcaggttcagttggatatttaaatattgatattactgaaggaaattatcttgttaagaataatggtaacatttttaattttaataacgctgttgattatttcgttgtaaaatctgatggtgcttctattacattcgatcctacttatacgagaagagaggatcaatgtgtcaataaggatggtaaattaattacgagatttgaggacttttgtgataccgaaaatagttctggtaaatatattacttgtatgaatggtagttgtattggaacttctcaagaaaacggtagtaaaactaatattagtgctgatccctgtgaaataactgtaactgcaaaaactactttcgtagatgcttcttgtagtgcatcagcaaaatgtaatagcaacaataacggttatcatttaggtacagatgctactggtaacaaatatttaacactttttaatgttagtggtgataaaagaacttgtgaagttattgaagaaccatctgttggttactatcgtttagcacttagtaaaattagtgttagttctggtcaaatcaaagattcttatcaatatgttattgaatgtaaggatattaatgatgacgttggttgtcaacttattcaattaccaactactgaaggtatggaatgtgatagtgataatgccggtaaattaattaattcaaattataatgctgtattatgtcttgatgaaaatgaatcacaaagatttgtcggtagtgatcctgttaaaaaatttgttaaagcagttgaaggtagtatttttggtaggacagctcaaaaatactatccagtagatattaccagcaattatataatttatgataaggactatgacaaatctggtatcttaatggatggtggaagagtaaattgtaatggatcaccaagtgtttgttcagtatccaatttgaaattcaatccttcttatacttatacatatgttgaaactcctactaagacaccgacttcccaaaaatttgtaccttcagcaactaattatgctgcaacggataaaggatattactttattgatgatgatggtaagactgtaactgatactactaccgatggttatattgtttattatgatggtgctggatcctctactacagttacagaagttgctggtatttatatgaatcatgatggattgacttcgacggatttcccatatattatctgtaaaataaaaaatataaaaattgatgaaactcaaaatgaaaatgtcgaaataactataggaggaaaaacttataacaatattaaagttaaaaaagttaaatgtaatttaagagctgaacctactactgatatatgtagtactgatggtaatttagttaaaattagtgatgataatggagaagaatccgtaggattatgtgttaattctaaaggaattaaatttgaaagtcatgaatatttatatggtttggacaatcaaagtattggttttattgaaggtcaaagatattatgaacttcaaattggtcaagttgttgataaagatactaataaagttacagatgaatatataaaatttaatactgtaagtaaaaaaggttatataagtgttagtaatgattctgatgtaataaattgtgttaaaagagatgatgctacggaacttgatacttctaattgtaataaagttactgcaaatgaatttgattattattattattcagaagattatataatctattgtgatggaagtaaaaaatgtacttatttaagtagatcggattatgtaggaaaaaatggattattccatgttatttatggtggtgatagaacttatgtcattagtgcaaaaagtagtggtggtactgatgctaaatttaaaattcaaaaaggtgcaaattattatccagtaagttcaggttccagtagtaattataaatttgatttgattaattgtagtggtgtcagttgtaatatggaaagtggtattggtagaggcgtatatctttatggaagtgataaaggtttaattatttgtactgcttcacagtgtggcgctggtgaatcgactgataatcctttacaatctgatattggaaataaatattatttaaatgctggaagtgataaagaagataaaccattaattaccgttaaaggtgtagaaattacaagtgcagaaggcacaaaaacaatcgtatataagtgggttaccgatgctgcatcggtaaaaactttatatgttaacgaaaacggaaataaaaaacttatttattgtgaagcacaaaattcatgtgaagaaattgacgcagtttcttccaaatatatagatggattgggtaaaaaagttattgattgtactgtgagtggaaataaatgtaataaattagaaatgtttacacaatctcaatatggaacaaacgtatatttaattgataataataatcgtattttacaagataatgtagtcagtggaagtctaattaaatgtacttacagagaaaaaaaagaaggtgaagatgaagatcaaaaaagttgtgaaggattagaagtagtagaaggaaattattatgtagatagttatggtagtaatcttattgacagtaataaaaatattattattaaaagtaaagttgctagtggttattatagaagttcagatgaaaataaatatatagaatgtactaaaggtactggatgttctgaaaaagattctgctgctgattgtaatgaagatggcagtgcaggtaaaattaaaaaaggtagtggtgatttgactttatgtcttgatgaaaatgcaacattaaatacttcaggtaaacatattaaaaatcttagttatttccctggtagttctggtgatatattaattagtgttgaaagtaataaaattgttgaagtaacaccaactagtattgaatattacattaccgatgaaaatggaatattattaactgaaggaaataaagcaggtaatttatataaatgttctaccgccggatgtgaaggtggaaatgttgctggtatatataataatgctgatataaatactgttgtcaatttccaaataattcaatgtgacgacgaagctgttagtaaaagagatggcgaaggtcctacctgtataggtaaagaacgtgatactgaaattaattgtttaaccaataataatttatattcatgtgctgaagatgcaaaatgtgatagtacttttgaaggttttgaaagtgtatgtaaacaacaaattgtaactgcaggatattatgttttaccaaaaggaagtaatgaaggtatcattcaatgtactagtagtggagctacagtgtcatgtgaaaaaaatactgaagttaaagaaggttattatataagtcaagatagatcaaaacctttaataaaatgtgaaaaatcattaggtaaagtaatgtgtatttctgttgatattgaagatataaatgatggtgtataccttagaaaggtagttgaaagtacaaacgttgtaaatgcattattaaagtgtaccggtaaactttgtgaagaaattgatatggtaaccggatattacttaagtggagaaccagataaaaaattagtatattgtgatggaacaacgaagttatgtgaatcagatagtaaaccatcagaaggatggtatgcaaatgctgttcaaagtggaaaaggtttaattaagtgtacaattgatggtagtaaatcatttgaatgtaatgaggaagttacaaaagtaggtacatatattaatgctggagtaaaagaagatggtaaaaagttaattgtttgtacattaagtggttgtacggaggaagaaccagaagttgaagcttattatgttgatggtgaaaatagtaaattaatatatagtgatattaatagtaaattaatattaattaaagatccaggagttgattcatggtatttatcaaaagaaggagaaggaaatttaattaaatgttatagtgaaaatgacaacgtagtatgtaaagagtatatgaatgaacaattgggaaaaggatattatatcaatggagatagttatagtaattatgaatatccattaattcgggttattagtagtactaatagtaattttgaaaaaggtaaagtaagtacgaagggatggtatgtacatgaagatgatgatgtaggaaaaaagattattaaatgtacaagtgaaagtagttgttctttaattgacgtttcagttgatgaatgttctttagctaatggaaaattttcaacatattatggtgatattgtatggtgtaatggtgaagaaatagtgtcaattagagatacttctcagcagacatatgtagtagccgctataactgattttgataaagatattgttttgcctgacggatatgtagcttctgatacttatgttatattaaaaaaagcatctggtaatggtttatcattagctcaagttaatactaatggttattattatgatagatataaggaaaaattatataaatgtagtaatgatagtaatggatattgtactattatttcacaagatgatatcgtagatggattttatttcaattttaaacctccaattgatagtgaaaaaattataagatgtgaaaataaaaaatgtagttattacactcttactaatactgatacaaaatgtggaagtgagaatgttggatttaaaaacggtgtttatttatgtcaaaatggagatcttagtactacatttaattttgaagaattaacgtctgaaaaagtatacgttcttaaatcaaagaatttcccaggtgtaaagggaagatatgtaatggttaatataagtaaatattcattattattcaaagaagaagttgaagaattagcaaaatgtacaacaagtacagaagctggttcagtatgtttaagtgtgacggcagttaaacaacagagtgataaatatacattagttaaaggtacaacaacaataactacagctggtgatatagaaattagtgtaagtggaaaagacgaaaaaattaaatatgattttgaaacaaatgcaggatatttcaaatataatattaaatcaggagaagccgaactggtttctttatttataccaaaggaagattttaaatatgaatgtaaaatagatggacaatgtattgaaagagaattggcggaagaacttatatatggatatgatgttacagatgaaggtgtaccaactaagattgtagctaaggcatctgtaaaaagaagtgacgatgatagtaaagttattgttttagatgaaattaaaaatggttggtatgcaaaaaaaggaagtggttgtattgaatgtaaagatggaagttgtgaaccgaaaacttcatgtgtaattgaaagagaaacaggtacagctaacattaaatatggaacttataagtctgatccatcgcataataaggtagttagtaagattaacactggaaagagaagacgtgctacaggaagtgatagtgatgatatagtgatatatgaattgaactatgtatctctgacagaaataaatgatagtagaaatatatttactgatggggataatgtagtattatcatcagatgatagtacaatttcaaatgcttattcatgtattgaaggtaaatgtaaaagaattgttgtcgaggatgataaatattatttgaacacaatacaatctggtaaaaaaataaatgctgtagtaaaatgttataaagtaacagggggtagccagggaacttcttgtatttttatagatgcagtagaaggaaatatgtatgaaaatgctgcaggaacaggtattgaagatgcattaataaaatgtactaatgaaaaatgtgaagttacaaaagcagagagtgaagttgctatgattccagaatgtaaaccaagtttatcaacaaatgatccatatataaatccaattacgttgaactgtattagaagtgacaattcattatacttattacagggtcaacattgtatttataaaggagatatatatatatatgatacatatactgataattcaaacccaacaagtccaaaaacttatttgaagtgttataatgtcaatactgttgatactagtactgatgtgaaaatgtttgatataacttatagaaagattaatatagaaaatatgaaagaaaaacgtattggtagttcaatttatacaaaagtaggtaatggaaaatggcatttaactaatggttatattgtaaatgtttcaacaaaggtattttcaaaatgtatgaagtcagaatgtgaggaaatgaaatctattgagggaacaagttgtgaaaatgaaggtgcaggtagtcttattttggatgctaataaaaatattaaattatgtaaaagtgatgttagttctggagctgtagatataagtgaagataaatattatcctattgaattatttattgatggtaatttccctgaggcatcaacaggtgatagaatattagtgggtattgaaaaaattggagcaaataatgtatatgttatatcaaaattggtatcggataagtttattttattagccactggaaatgctattgcgtcatcaagtcatgctgataataaattatatcaatgtacaagtagtgatagtaactgtgtgatattggaaaaaaataatggatggtatagttctgaagatgatggtaaatttattaaatgtgaagatggtacatgtggtgaagttagtgaagcaactgagatagaatatataagtgagaaatttgatagtattgataatggagaatttatatataaagataataatttaatgattagagatgaaaattcttttgtccaattcaaagtaaataattatgtattattgaatgaatatgaaaataggttagctgaagaagatgaagtaaaggagatgaaagtattattgaaatgtaatgaatcatatggaaaatgcataaaagaagaagatatcaaagatgggtggtatgttaatggtgatactgaatataaaggaataaaatgtagtaatggtagttgtgttgttgtaaaagagttatctaattcatgtggtaacaataatgatggagatttaatatatgatactagtagtaatgagtattctctttgctattctaaaacacttatttctcttaaaaataatgttggtaaaaaaataagtctatcttctaataataaattcccaaataacaaggattatgttgtagttatgagtaattctgttataggtataggtaatattggtggagtaggtggaaatgttgaatcttcagtatgtactaataattgtaaaaatggaagtagtgttcaatgtaaaattactgtaggagaagaggatatagtactcccagtaaatagctattgtactttagtacaaggtgaagatataactatttataaaggaaaagatgcagaaaatagtgaaaaagcatttactgaaggaaattcagtaatattaattgatggaaatagtttgataacaaatgtagataatgttggaccaagtactgaaatgtattattgtataaaaggtagttgtaaagtaggtgtaggatataaaaaattgggtgatagtattgttaagtgtggagctgatggttgtgagaagtatgaaacaccaggtagtgtaagtataggtgatattagtagtggtaatttgcaatatgatgaaagtaaaagtggtggtggcgatagtaatagattgtactactacattaataaatctaatgttttccctggatctgaaaataaaagttcatttttagttgaagcaggattagattattatgttatatttaaaggaaaaggttactatttattgggttctgataacaaaatgttggaaggaagttcagcaaagaataatgattatgctggagacaagttatatttatgtgatgaattgaaaggaaattgtattgtacaagaaactaaatcaaatggatattttgttaatgcagttgatgaaagtatgatattatgtaaagcaaataaatgttatatagcatatatagttgatgatagctgtagcaaactaggaaatgtagtaaagaaagatggtaaatataaattctgtaatgttaagggaactaatagtccaattgaaataaaagaatcttcaagtgttaattattatatgctaagtttaggaagaggtgataaatttgctggtattacaattccagatgaagaagcaaatgacgaagtagttgttaatattattgtaaaatatacaggaactactttaactcaatatacaaaagaaggatatattttacgtaatggagataatatagttgaaaatgtaaatggttctggaaatatgtacaaatgtgaaaaagaaaagtatattggtactactgaaactgtacaatgtaaattaatggaaaatattaacagtggatggtatttcagtgataattatgaaaataataagtatataagctgtgacaacactaaagaaagtaataaatgtaatttgatggaagctgtagaaagtaagacttgtcaaaatagtggaatacttatatataataatgaagaattaaaagtatgtgtaagaagcgataagcaagtcggtattaaaggtatttctgaaaagtatgcgatgattatgaatgtatctaatacaaaagatttcccaggatttaaagtaaaaacaactaatattgaaataattacttctattagtagtaattcagtaacatgggttgatatggatacatttgttgttgtcaatgatgaaaaatatggtagacgtgttataacaacagctggtagtaatgttggaggtaaatctgaagaaggtaacttatatagatgtactgctcaaagtggatgtaaagttagtacaaatcctgaagaaaattggtatattatgaaggatattagtagtggtgagccgaataatttaattttatgtgaaacagaaagtggaagttctgattctggtgaaagtaaaatgaaatgtactatgacagataaaaatgttaaggaaggattctacgcaaattggaataaagaaaaaccattaattcaatgtgttcaacccggagaagagaaagaaggtaaatttactaattcagctggaaagaaagttgtttgttttgaaaaagattataaagaaggatggtatattagtggaaatggaaaattaataaattgtaataaagaatttggatgttatgaagaaagttctccaagatatggtttatatgttaataatgaggcaaatgataatatatataaaaatgaagaatatacaaataaaacaatatataaattaataaaatgtaaaggaggaagtagtgctaattgtgtgtcttacacaaaagaaacagtaagtcaatgtagtaatgaaaagccaggtgaaattaatgtagataatactggaaattataaattttgtttatcaaaagttgatcatacttcagataaagtagaagctgttgatttcattaaaagtagtggtaaaaaatatggaattcttaaaatatcatctactactgatgatttccctgtttctgaggcaggatataatttagttgaaatttcatcaaatgaaattagtgttgttaataaagaaggctattattacattgatgatataatgtttaactgtaagagtacaggaaaatgtgaaaaagaaacaagtggaggtattacagtacttgacagtgttagtaatgtgatgatgacaagtccatgtacggaaggatcatcctgtaatgataattggatagttgataaaagtgatggaattatattgttagatactaataacaagataataagtacagtagataatgttaatgtaaaaaaagcttacaaatgtaaagataataaatgtattgaagtaaattatgaaggttattattataataaaaatgcacaagatgaaaatggaaataatgtgttgtatcaatacaagaaagataaaaatggtgtaatgaaatggagtatagtaaataatgaattattgaattgtagacaattaagtgaatataaaccaaataattgttatatatcttatgaagatgagaaatataaggcaaaacttgaagaaattaaagtagatgcgggtggtatttgtgtaagttctacaaataaatatttagcattgaaagaaataaatacaggtattgatgttgaaaattgtgttcaaatgccaagtgaagcagatgtaagcacttattattataatgttaatggtaatgcatatgcagttgataaatattcatatatgaatattggtggtaatggacaaggtgttgttattaattcattaaatggtgaagtaataaataataataaaaaattaaataaaatattgaaagatgattataatactgcttctgaatatataattagttgtaatgaaggaaattgtgtgtcaaaagttgcaagtgcatgtacctatgatttccaaagtggtaaatgtaaagcattaacggaaaatgtaaatagtggagaggtatgtataacagaaaatagaatttaccttgcattggaaaatttgacaacttcaagtgaaggtagttgtacaccatatctgtataaaaaaatgaatagtggtgaagatgttaaagatgaaggagatagtttaataaaagttgctaataaaaaattgtatgaaattactagtagtaatgaaatatataaatatagtgatggtatttatattgttaatgaagctgatagagttgttgaattagaagatgataaagaaattgatataagtggaaaatcgaatttgaaattatatgtatgtaataaagaatgtaaattgaagactagttgtggagttaatggaaaggatgaatatatgttttataagaatgataataatgaattaacttatgataagttatataaatgtaattctaagaataataaattaagtatagtaaaagaaagaaaaggttattatttaaattctgcatttaataacttaataaagtgttatgatagtggtgattgtaaggtattagatgaggagaatggtatggaaggatattatgtagatggaggtaatgaaggattaattataaaatgtatacgtggaacagaaaagtttgtatgtaaagaggaaagcgttgtagcttgtgaatataatagtaaagaaggagtatgtaaatcagaagataatttattaagaaacagttattgttaccgttctggaaagagtaatgaaaataaattaatatatgtagagaactttataaaagcaggagataagggtaaatgtatagctaatgatggaaaggattacttctacaaatataaaaaatctaaattccttggtcataaagagagagatgatttaattaaatttagtgaagattcaattgtaagtatatttgaaaataatatagggtattatatatttaatactgaaactcataatggtgttgaaaaaagtgtggaattgaaaaagactagaatgtatgaatgtaagaagcaaaattgtgaggaaatattaaaacctcaaataaataaagtctatattaataaagcttcaacggaaaaattaattaaatatgatggatctcaaaagtcatgggatgttattaaacgtcgttgtgtaataaataataataatacaaaacaatgtacgctctcagaaagtatcagtaagggtgaattgatatatgttgtttatgatgatgaggttaaattctataaatccagatatgatgtaagtaattatgtaactagaaatccagttaatgacgatgatgaaaagaaaagtcattattcaatttcagataataaatatcatttattgcaatctaactttgaccctaagagtaaagtaatgcttatgttgaatagtggaaaacaaacggtagattgggttgaagatgaaggttattatatatttgaaaaaagtgaagaagaaattaatcttattccatacagaaatactcaaaatgttacgcttgataagaaaactgaaattacggtgtatcagaaaggtgatagttggaaagtaataagtgatgtggtaaagactttcagtaatataggtatatactggaataaagcaagtataaatgatgaaggtgtggtaattcaatcaatgagtattccaataaaggaagaacaagaagaagaaggtagtgctagaagaaaaagagcaactggaagttcaggaggaaattcaagaattaagagtgtattaaataaatgtatagttaatgaaaagaataaatgtattaatgtacaagaaggagaaattattccggtaggttctccatgtatagtcagtgatggtgaatacagtggtttatatttagctataagtccaatttctgaaaatgcttcatctgaaaattgtgtaaaatatgatgaaggaacaagttacgttaatttagatgatgtagaattttcaggtggatatgtatataatagtattgtaagagttgaaaagaatgaaatgttaatgtttactgacggaggtaatgataataatccatatattggttattatataattggagaaaagaataaaccatttaatttaactgtacaaacggaacttaaaggaaattccaaaggagcatatttatgtggttacagaatggaggagaatccagatactaatgagatgaaagaaactgatatatatgaatgtagtagttattcaggagaagatgcttattattatgctaatgataatataggaagtaatggtgtatactatggtaaaggaaataaatggatgaaagaaagtagtagtggttattacttctttaacagtaaaaatgttgcagcaaatataaaggaagaaataccagatactggagtatttgatggatatggtaatgctgttaacaatggtaaatatataaatagtgcagtaacagatagtaataatgagattgttgttgttaataactatgaaggatcttatacaattaatactgatattaaaaaatgtaaagtaaataatgatgagacttgtgatggagatagtgaagaagttacattaaccgataatgatatttgctacacattatcaggaaataccaaaaagttgtatattgttgaagtaagtgtacaagagagtggagaagagtcagttactaagaagttatgtcatactggtggagtagatgctgttaagtattacatgagtggatctaatttatatagactggatggactttcagtacaaggaatgaaaagtggtatatttgtgttaaatgataaaatggaaggatttagtagtgatatatatgaaattccatataaggtaattgaatgtggaaatggtaattgtgcagaaaaggagataataaatgttgaatcagatgttataattaatggagctggaaatggtaataatcaattattgaaatataataaattaagtaaaaagttcatgaatgttgatcaacccggatattatttatttaatgaagatggtagtgtaaatggtgatgaaagatacagtaaattatatgaattaacgaaagacggtgaattaaaaacattaacagaagatgatattaacatgaagaatatatatattaatttcgctaaagaaggtgaaattactctaggattaaagaaaatagtcagtggtataattgaatatgatagtggaaataaatttcttaagataaaaaatagtaataaaatagaaaatgtatttgttataattgataataaattatataaaaaattaacaagagagttagatgaagttgacgaaggaatatatgctatgaaaaagaatggcaatgtatttgaaccatttataaatactgttgaagagaatttaaatactgcgcaatatgaagtatgctattacgatggaaagagtttaccatgtaatgttcaaaaattggaagaatttaagaagagaaatgtaatggttaataaatctaatggaaaagaaaatgtattagaatataattcaggaactaaattatggaaaatagtaaaggatgatggttattacttcttctttgaagatggatatggtattaacaaagcggataatagagttaataaagtacttcaaatagtaaatggtaatgttaacgatgttacagaaggaattaaaaaatctggattttatgtatttaaaggattaatggttgaaaatactaatgataaatgggaagatgctgaactagcagtagataatgttgttgtaacaggaagaaaaggatgtaaatcctacgaaattcgtgaattgattgaaccacaagaattttgttatgaaagtagtagaggtatttgtattccaaaggtagaaatttcacagaaatctgatgataataataattgtatgttcagtaccgatgatggaatatattattatcttgtagatgatagtttatatgcacttagtaaggatagttataaccgtatcgaaaagtcaggtatatatgtagtagatttgtatggaaagatttatgataataagaaagaaaatagagctattgcctattcatgcaaagaaggaaaatgcggtattactaagagtttaaagagtaaatattatatgaattttgctaatgataataaagagattcctgttatattatactatgatagtgaaaaatctacatgggttaaaacttcaaaagatggatattacttctttaatgaaaatggaaagtctgtatcagtaggaaaggaagttgcctatgcttttgaagtaagaaaggaaggaatggaaattgtaaacattatggaaaatgttagtgatggtaaatatgtaagtcaaagtaatccaagtgaagctattattgttgagatgaaaggagtatggcaaaaaccagtttcagttccaacttgtactgttgaagaggatggaataactgttacttcaagtgaaccaatggaaagtggtgatatatgtattgataataaacaaattgtaattattaaaggcgaatcagaattagctaaacgtgatggtgaatatagttataagtctgtaagtagtgttggaagaaatgcatacgcctatattgagaaagataaacaacttttacgagttaaaaatgatcaaatatcagttgtaaatgtaaatggatatgttttattagataaatcaacaggtattccattagaaagtaatgaagaagttgaaggagaattatatagttgtaatggaaagtcatgtgaattagtaaatagtgacaaaattgatgttggtaatagatatgtaaataagttggcagagaaattaccattaattaagaatgtagatgttgataaatgggcagtcgaaatggaagaaggatacttcttcattaataataagcaaaaggcagtagttgctaaggatactgttataagtgcctttgaagttttgaatgttaatggagtattaattcaaaatgatattacgcaaagtaattcaccaggtatatacgttaataagggaggaaatgttaagagtgttataaccaatgatggtagttcatggaatgccggtgaaattgtaacatgcaaggttactgaaaataaggatggtacaagtaactgtaagacatttaccgaagaagaaactattgaagcaggtaattattgttataataaggatggtaaagaagttggaaataagatgtatttaattacggaaactgcaacttcagctattgaaacaggaaattgtttaagtgctgctgctgaatcaccattatatttaacatctgataaaattggaggtaaattaaatggaactgctgtaagtaaacttgttaaatttaatggtgaatatgtaacattggttaaaccaggatattatatggttaatcagaataataaattagttgaagaaagtggtgaaaatgttttaatatacgtctgtgatggaagtagttgtagtgttgattctgctgtattaactactggtgaaagattcctttcagatggtaagatatttgaatatgataaagacggcaagaagttgaagaaggttaccgaaattggtttgtatgtatttaactctgaaggtagagcagcaagtaatagtgtagatgaaaataatattcttctaatgaatgaagatggaagtattgaaaagattgagttagaaagtggaatttatataaatattgctaataaaaatacttatgttgtatatgatggtgaatcttatagtattaagagtgttacttgtacttataataaggatggaggaagttgtgctaatgaaagtgtaatatttaatattggtgattattgtatatccgatggtaaattctatataattaatggacttagtggtgaaaacaatgaaattaaactatgtaaagtaggtagtgatgaaaccccagtttattacgataatggtaaacaaaaattaataatggtaaaagaaaaggaaatctatacagtaagtgaagaaggttactacgctattgatgtcacaaaggaaagagctttagattctgaagacttagttaataccaaacttattaaatgtgataatggtggtagttgtgaaagtgttaaacctgaagtcggtagttatcttaaccgtgctccagacccatacgctattgctcaattcacaggtgaagaagataaggcctttactattgaaagagaatgtaatgttgaagttagtgaaaatggacaaagatgtgtagttgaggatggtgaattaaatgctggtgatgtatgtttatcatctaatgtattgtacttagtaggcgaagataataatgaatgtgttgccactgaaaagacagttgatacctataagattgttaataataaattatatagattgaatgatgattccgttgttcaattattagatggttattacttcattactaaggaaggacatgctgttactagaagaaaggattatgaaaaggaaggtactgttggttacatatgtagtaagaagggagattgttatcaaatagaaccagaaggtgtgagatattacattgattacactactatgaccgataatcatttcgttgttgtaaagtatgatggatcaagaagagatttaagaaagcgtcaagaagaagaaggtggtgaagaagaagaagaaaaagaagagaatactgaaaagggtgatgaagaaggagaaggagaaggtaatgaagctaatggagaagaaaatgaagatgaaggtaatgttgatagtttcgaagaagaagaagatgaaggagaagaaagcgaaggaaatactagtggaattgaaaacattactgaaccaggtgtttacaagttagatgatggaagttatgtagaatgtgaattagataacaatgaagaaataacctgtaagaatattgataaagaaggtagtaagatgactactgatggtgaagtagttgcttgtgtaaagaatgataaggatgaaattgtatgtacacaagctacagaaggaggctattattacatcgatgatgaattaatggaatgtacagccacagaagaacaagataaattagaatgtgaaaaggttgacaaggaaggttacttcatatctgaaccaaatgatttagtatatgaatgtgttgaagtagaagaagaagaagaggaagaagaatatgtacctgacaaagatttggaagatccagatcttagaaagagaaagcaaaagagatttaaagaatataatgtacaagccaatgaagttaatggagaagctgaaactgaaagtgctgatgctaatgacaatgaaacagaaaatgatgaaccaaagaatgttaaatgtagagtaatggaatgtccaggagatccaattaccattaaacttgaagatggtgaaagtaaggatgtatatatatgttctactggtgaagatgaagaaagtagatatattgatccagatccagaaagtagtatatgtgaaagtggatcatacattaagaaaggagaagattattatgaatgtgatgaagaggaaaaaggtaaattggatccaaatatgttggttgaaccaaatactgaacacaccacctcttaccaaccaagaccaactccaactacagctcaagaaacatcagcacctcctactaaatcatctgaaacctctaaaccaacctctacaccaactcaagcaccaagtggtgccctttcattaattcataaaataccttcaattactttctatataatactatttgtttttgctttcttaattcaatattaaatataaaataatatttatcatctaaaagaaaatatcttatatagtaaaatttaaaaaaaaaaattcagtaatttttaaacatatttattaatagttttatttattttacaataaacatacgtttaatcatacttatcattaataaaaaaaaaacaaacaaataatgaaataataatcc
